United States Patent
Schurpf et al.

(10) Patent No.: US 9,399,676 B2
(45) Date of Patent: Jul. 26, 2016

(54) COMPOSITIONS AND METHODS FOR GROWTH FACTOR MODULATION

(71) Applicant: SCHOLAR ROCK, INC., Cambridge, MA (US)

(72) Inventors: Thomas Schurpf, Cambridge, MA (US); Nagesh K. Mahanthappa, Cambridge, MA (US); Michelle Marie Straub, Brighton, MA (US)

(73) Assignee: SCHOLAR ROCK, INC., Cambridge, MA (US)

( * ) Notice: Subject to any disclaimer, the term of this patent is extended or adjusted under 35 U.S.C. 154(b) by 0 days.

(21) Appl. No.: 14/795,033

(22) Filed: Jul. 9, 2015

(65) Prior Publication Data
US 2015/0337034 A1 Nov. 26, 2015

Related U.S. Application Data

(63) Continuation of application No. PCT/US2014/036933, filed on May 6, 2014.

(60) Provisional application No. 61/819,840, filed on May 6, 2013, provisional application No. 61/823,552, filed on May 15, 2013, provisional application No. 61/900,438, filed on Nov. 6, 2013.

(51) Int. Cl.
*G01N 33/53* (2006.01)
*C12N 9/00* (2006.01)
*C12N 15/12* (2006.01)
(Continued)

(52) U.S. Cl.
CPC .............. *C07K 16/22* (2013.01); *C07K 14/495* (2013.01); *C07K 16/005* (2013.01); *C07K 16/2863* (2013.01); *C12N 15/1037* (2013.01); *A61K 38/00* (2013.01); *C07K 2317/21* (2013.01); *C07K 2317/24* (2013.01); *C07K 2317/31* (2013.01); *C07K 2317/565* (2013.01); *C07K 2317/76* (2013.01); *C07K 2317/92* (2013.01); *C07K 2317/94* (2013.01); *G01N 2333/71* (2013.01)

(58) Field of Classification Search
None
See application file for complete search history.

(56) References Cited

U.S. PATENT DOCUMENTS

| | | |
|---|---|---|
| 4,179,337 A | 12/1979 | Davis et al. |
| 4,301,144 A | 11/1981 | Iwashita et al. |

(Continued)

FOREIGN PATENT DOCUMENTS

| | | |
|---|---|---|
| EP | 0239400 A2 | 9/1987 |
| EP | 0404097 | 12/1990 |

(Continued)

OTHER PUBLICATIONS

Graille et al., 2000. Crystal structure of a *Staphylococcus aureus* protein A domain complexed with the Fab fragment of a human IgM antibody: structural basis for recognition of B-cell receptors and superantigen activity. PNAS. 97(10): 5399-404.

(Continued)

*Primary Examiner* — Elizabeth C Kemmerer
(74) *Attorney, Agent, or Firm* — DT Ward, PC; Donna T. Ward; Christopher P. Sullivan

(57) ABSTRACT

Provided herein are proteins, antibodies, assays and methods useful for modulating growth factor levels and/or activities. In some embodiments, such growth factors are members of the TGF-β superfamily of proteins.

7 Claims, 23 Drawing Sheets

(51) Int. Cl.
  *C12N 15/13* (2006.01)
  *C12N 15/63* (2006.01)
  *C07K 16/22* (2006.01)
  *C07K 16/00* (2006.01)
  *C07K 14/495* (2006.01)
  *C07K 16/28* (2006.01)
  *C12N 15/10* (2006.01)
  *A61K 38/00* (2006.01)

(56) References Cited

U.S. PATENT DOCUMENTS

| | | |
|---|---|---|
| 4,444,887 A | 4/1984 | Hoffmann |
| 4,474,893 A | 10/1984 | Reading |
| 4,485,045 A | 11/1984 | Regen |
| 4,496,689 A | 1/1985 | Mitra |
| 4,544,545 A | 10/1985 | Ryan et al. |
| 4,640,835 A | 2/1987 | Shimizu et al. |
| 4,670,417 A | 6/1987 | Iwasaki et al. |
| 4,714,681 A | 12/1987 | Reading |
| 4,716,111 A | 12/1987 | Osband et al. |
| 4,791,192 A | 12/1988 | Nakagawa et al. |
| 4,816,397 A | 3/1989 | Boss et al. |
| 4,816,567 A | 3/1989 | Cabilly et al. |
| 4,925,648 A | 5/1990 | Hansen et al. |
| 4,946,778 A | 8/1990 | Ladner et al. |
| 5,013,556 A | 5/1991 | Woodle et al. |
| 5,024,947 A | 6/1991 | Inlow et al. |
| 5,091,513 A | 2/1992 | Huston et al. |
| 5,116,964 A | 5/1992 | Capon et al. |
| 5,208,020 A | 5/1993 | Chari et al. |
| 5,223,409 A | 6/1993 | Ladner et al. |
| 5,225,539 A | 7/1993 | Winter |
| 5,258,498 A | 11/1993 | Huston et al. |
| 5,403,484 A | 4/1995 | Ladner et al. |
| 5,413,923 A | 5/1995 | Kucherlapati et al. |
| 5,427,908 A | 6/1995 | Dower et al. |
| 5,468,845 A | 11/1995 | Oppermann et al. |
| 5,475,092 A | 12/1995 | Chari et al. |
| 5,516,637 A | 5/1996 | Huang et al. |
| 5,530,101 A | 6/1996 | Queen et al. |
| 5,541,087 A | 7/1996 | Lo et al. |
| 5,545,806 A | 8/1996 | Lonberg et al. |
| 5,565,332 A | 10/1996 | Hoogenboom et al. |
| 5,569,825 A | 10/1996 | Lonberg et al. |
| 5,571,698 A | 11/1996 | Ladner et al. |
| 5,573,920 A | 11/1996 | Randle |
| 5,580,717 A | 12/1996 | Dower et al. |
| 5,585,089 A | 12/1996 | Queen et al. |
| 5,585,499 A | 12/1996 | Chari et al. |
| 5,601,819 A | 2/1997 | Wong et al. |
| 5,625,126 A | 4/1997 | Lonberg et al. |
| 5,633,425 A | 5/1997 | Lonberg et al. |
| 5,658,727 A | 8/1997 | Barbas et al. |
| 5,661,016 A | 8/1997 | Lonberg et al. |
| 5,693,761 A | 12/1997 | Queen et al. |
| 5,693,762 A | 12/1997 | Queen et al. |
| 5,698,426 A | 12/1997 | Huse |
| 5,723,584 A | 3/1998 | Schatz |
| 5,733,743 A | 3/1998 | Johnson et al. |
| 5,750,753 A | 5/1998 | Kimae et al. |
| 5,780,225 A | 7/1998 | Wigler et al. |
| 5,786,464 A | 7/1998 | Seed |
| 5,807,715 A | 9/1998 | Morrison et al. |
| 5,814,318 A | 9/1998 | Lonberg et al. |
| 5,821,047 A | 10/1998 | Garrard et al. |
| 5,846,545 A | 12/1998 | Chari et al. |
| 5,885,793 A | 3/1999 | Griffiths et al. |
| 5,916,771 A | 6/1999 | Hori et al. |
| 5,919,652 A | 7/1999 | Pang et al. |
| 5,932,448 A | 8/1999 | Tso et al. |
| 5,939,598 A | 8/1999 | Kucherlapati et al. |
| 5,951,983 A | 9/1999 | Bazin et al. |
| 5,967,979 A | 10/1999 | Taylor et al. |
| 5,969,108 A | 10/1999 | McCafferty et al. |
| 5,972,335 A | 10/1999 | Ferguson et al. |
| 6,075,181 A | 6/2000 | Kucherlapati et al. |
| 6,096,506 A | 8/2000 | Lee et al. |
| 6,114,148 A | 9/2000 | Seed et al. |
| 6,114,598 A | 9/2000 | Kucherlapati et al. |
| 6,180,370 B1 | 1/2001 | Queen et al. |
| 6,348,584 B1 | 2/2002 | Hodgson et al. |
| 6,368,597 B1 | 4/2002 | Strassmann et al. |
| 6,407,060 B1 | 6/2002 | Charette et al. |
| 6,468,535 B1 | 10/2002 | Lee et al. |
| 6,492,497 B1 | 12/2002 | Thompson et al. |
| 6,656,475 B1 | 12/2003 | Lee et al. |
| 6,673,901 B2 | 1/2004 | Koide |
| 6,784,999 B1 | 8/2004 | Tao et al. |
| 7,015,906 B2 | 3/2006 | Olschewski et al. |
| 7,070,784 B1 | 7/2006 | Halkier et al. |
| 7,151,169 B2 | 12/2006 | Thompson et al. |
| 7,297,961 B2 | 11/2007 | Kang et al. |
| 7,316,998 B2 | 1/2008 | Knopf et al. |
| 7,320,789 B2 | 1/2008 | Aghajanian et al. |
| 7,358,056 B1 | 4/2008 | Hoekstra et al. |
| 7,371,726 B2 | 5/2008 | Junker et al. |
| 7,432,079 B2 | 10/2008 | Junker et al. |
| 7,569,390 B1 | 8/2009 | Eric et al. |
| 7,572,599 B2 | 8/2009 | Lee et al. |
| 7,608,453 B2 | 10/2009 | Cattaneo et al. |
| 7,632,499 B2 | 12/2009 | Davies et al. |
| 7,635,760 B2 | 12/2009 | Han et al. |
| 7,723,486 B2 | 5/2010 | Ledbetter et al. |
| 7,738,107 B2 | 6/2010 | Ohtsuka et al. |
| 7,750,128 B2 | 7/2010 | Gegg et al. |
| 7,785,587 B2 | 8/2010 | Whittemore et al. |
| 7,807,159 B2 | 10/2010 | Chin et al. |
| 7,863,569 B2 | 1/2011 | Hong et al. |
| 7,884,054 B2 | 2/2011 | Zhou et al. |
| 7,888,486 B2 | 2/2011 | Walsh et al. |
| 7,897,347 B2 | 3/2011 | Tse et al. |
| 8,063,188 B2 | 11/2011 | Sayers et al. |
| 8,178,488 B2 | 5/2012 | Knopf et al. |
| 8,236,527 B2 | 8/2012 | Chen et al. |
| 8,383,780 B2 | 2/2013 | Ledbetter et al. |
| 8,399,625 B1 | 3/2013 | Escher |
| 8,415,459 B2 | 4/2013 | Lavallie et al. |
| 8,420,082 B2 | 4/2013 | Veldman et al. |
| 8,455,448 B2 | 6/2013 | Jeanplong et al. |
| 8,637,637 B2 | 1/2014 | Sun et al. |
| 8,710,016 B2 | 4/2014 | Seehra et al. |
| 8,840,894 B2 | 9/2014 | Stitt et al. |
| 8,871,209 B2 | 10/2014 | Stitt et al. |
| 8,933,199 B2 | 1/2015 | Cload et al. |
| 8,992,913 B2 | 3/2015 | Mader et al. |
| 8,999,343 B2 | 4/2015 | Han et al. |
| 2003/0104402 A1 | 6/2003 | Zauderer et al. |
| 2003/0129171 A1 | 7/2003 | Grobet et al. |
| 2003/0235850 A1 | 12/2003 | Cattaneo et al. |
| 2004/0047891 A1 | 3/2004 | Glozman et al. |
| 2004/0115740 A1 | 6/2004 | Benson |
| 2005/0250936 A1 | 11/2005 | Oppermann et al. |
| 2005/0272107 A1 | 12/2005 | Rabbitts et al. |
| 2005/0276800 A1 | 12/2005 | Rabbitts et al. |
| 2005/0288492 A1 | 12/2005 | Rabbitts et al. |
| 2006/0034831 A1 | 2/2006 | Tobin |
| 2006/0034834 A1 | 2/2006 | Marasco et al. |
| 2007/0178095 A1 | 8/2007 | Smith et al. |
| 2008/0038748 A1 | 2/2008 | Kojima et al. |
| 2008/0206219 A1 | 8/2008 | Coussens et al. |
| 2009/0136481 A1 | 5/2009 | Kambadur et al. |
| 2010/0009424 A1 | 1/2010 | Forde et al. |
| 2010/0143939 A1 | 6/2010 | Rabbitts et al. |
| 2010/0196983 A1 | 8/2010 | Yang et al. |
| 2010/0322925 A1 | 12/2010 | Knopf et al. |
| 2011/0008364 A1 | 1/2011 | Ledbetter et al. |
| 2011/0053221 A1 | 3/2011 | Chen et al. |
| 2011/0123592 A1 | 5/2011 | Stevens et al. |
| 2011/0129469 A1 | 6/2011 | Koncarevic et al. |
| 2011/0135570 A1 | 6/2011 | Janatpour et al. |
| 2011/0250198 A1 | 10/2011 | Wolfman et al. |
| 2011/0256132 A1 | 10/2011 | Ashman et al. |
| 2012/0251457 A1 | 10/2012 | Kahn et al. |

(56) References Cited

U.S. PATENT DOCUMENTS

| | | |
|---|---|---|
| 2013/0122007 A1 | 5/2013 | Stitt et al. |
| 2013/0209489 A1 | 8/2013 | Han et al. |
| 2013/0336982 A1 | 12/2013 | Mader et al. |
| 2014/0105896 A1 | 4/2014 | Cload et al. |
| 2014/0256720 A1 | 9/2014 | Hong et al. |

FOREIGN PATENT DOCUMENTS

| | | |
|---|---|---|
| EP | 0519596 | 12/1992 |
| EP | 0592106 | 4/1994 |
| EP | 2314622 | 4/2011 |
| EP | 2422811 | 2/2012 |
| EP | 2703485 | 3/2014 |
| EP | 2832747 | 2/2015 |
| WO | 90/02809 A1 | 3/1990 |
| WO | 91/00360 | 1/1991 |
| WO | 91/09967 | 7/1991 |
| WO | 91/10737 | 7/1991 |
| WO | 91/10741 | 7/1991 |
| WO | 92/00330 A1 | 1/1992 |
| WO | 92/01047 | 1/1992 |
| WO | 92/05793 | 4/1992 |
| WO | 92/08802 | 5/1992 |
| WO | 92/18619 | 10/1992 |
| WO | 93/11161 A1 | 6/1993 |
| WO | 93/11236 | 6/1993 |
| WO | 93/17715 | 9/1993 |
| WO | 94/09812 A1 | 5/1994 |
| WO | 95/15982 | 6/1995 |
| WO | 95/20401 | 8/1995 |
| WO | 96/33735 | 10/1996 |
| WO | 96/34096 | 10/1996 |
| WO | 98/16654 | 4/1998 |
| WO | 98/24893 | 6/1998 |
| WO | 98/46645 | 10/1998 |
| WO | 98/50433 | 11/1998 |
| WO | 00/43781 | 7/2000 |
| WO | 00/54057 | 9/2000 |
| WO | 00/66620 | 11/2000 |
| WO | 01/12777 | 2/2001 |
| WO | 02/09641 | 2/2002 |
| WO | 03/008451 | 1/2003 |
| WO | 03/062415 | 7/2003 |
| WO | 03/077945 | 9/2003 |
| WO | 03/097697 | 11/2003 |
| WO | 2004/046187 | 6/2004 |
| WO | 2004/099775 | 11/2004 |
| WO | 2005/010049 | 2/2005 |
| WO | 2005/063817 | 7/2005 |
| WO | 2006/106599 A1 | 10/2006 |
| WO | 2006/116002 | 11/2006 |
| WO | 2007/050793 A2 | 3/2007 |
| WO | 2007/050793 | 5/2007 |
| WO | 2007/050793 A2 | 5/2007 |
| WO | 2008/060371 | 5/2008 |
| WO | 2009/018438 | 2/2009 |
| WO | 2009/114702 | 9/2009 |
| WO | 2009114702 A2 | 9/2009 |
| WO | 2009/144457 | 12/2009 |
| WO | 2009/144457 A2 | 12/2009 |
| WO | 2010/004432 | 1/2010 |
| WO | 2011/034935 | 3/2011 |
| WO | 2011/151432 | 12/2011 |
| WO | 2012/007167 | 1/2012 |
| WO | 2012/048332 | 4/2012 |
| WO | 2013/023251 | 2/2013 |
| WO | 2013/033420 | 3/2013 |
| WO | 2013/055404 | 4/2013 |
| WO | 2013/092001 | 6/2013 |
| WO | 2014/030780 | 2/2014 |
| WO | 2014/074532 | 5/2014 |
| WO | 2014/093531 | 6/2014 |
| WO | 2014/144573 | 9/2014 |
| WO | 2014/182676 A2 | 11/2014 |
| WO | 2015/015003 | 2/2015 |

OTHER PUBLICATIONS

Graille et al., 200t Complex between Peptostreptococcus magnus protein L and a human antibody reveals structural convergence in the interaction modes of Fab binding proteins. Structure. 9(8): 679-87.

Greenberg, Pathogenesis and therapy of inclusion body myositis, 2012. Curr Opin Neurol. 25(5):630-9.

Guo, et al., Myostatin Inhibition Prevents Diabetes and Hyperphagia in a Mouse Model of Lipodystrophy, 2012. Diabetes 61(10):2414-23.

Hahm, K. et al., $\alpha v \beta 6$ Integrin Regulates Renal Fibrosis and Inflammation in Alport Mouse, 2007. Am J Pathol. 170 (1):110-5.

Hameedaldeen, A. et al., 2014. FOXO1, TGF-$\beta$ regulation and wound healing. Int J Mol Sci. 15:16257-69.

Hamrick et al., Recombinant Myostatin (GDF-8) Propeptide Enhances the Repair and Regeneration of both Muscle and Bone in a Model of Deep Penetrant Musculoskeletal Injury, 2010. 69(3):579-83.

Han et al., Myostatin/activin pathway antagonism: Molecular basis and therapeutic potential, 2013. Int J Biochem Cell Biol. 45(10):2333-47.

Hassanzadeh, et al., 1998, FOXO1, TGF-$\beta$ regulation and wound healing. FEBS Lett. 437:81-6.

Hill, J.J. et al., The myostatin propeptide and FLRG are inhibitory binding proteins of myostatin in normal serum, 2002. JBC. 277(43):40735-41.

Hill, J.J. et al., Regulation of Myostatin in Vivo by Growth and Differentiation Factor-Associated Serum Protein-1: A Novel Protein with Protease Inhibitor and Follistatin Domains, 2003. Mol Endocrinology. 17(6):1144-54.

Hojman, Partial Inhibition of Integrin avb6 Prevents Pulmonary Fibrosis without Exacerbating Inflammation (2010), Curr Gene Ther. 10:128-138.

Hollinger et al. "Diabodies": Small bivalent and bispecific antibody fragments (1993), Proc. Natl. Acad. Sci. USA, 90:6444-6448 (1993).

Horan G.S. et al.(2008), Partial inhibition of integrin alpha(v)beta6 prevents pulmonary fibrosis without exacerbating inflammation. Am J Respir Crit Care Med, Jan. 1, 2008; 177(1):56-65. Epub Oct. 4, 2007.

Hsiao et al. Characterization of Growth-Differentiation Factor 15, a Transforming Growth Factor b Superfamily Member Induced following Liver Injury, 2000. Mol Cell Biol. 20(10):3742-51.

Huang, F.W. et al.(2005), a mouse model of juvenile hemochromatosis. J Clin Invest. Aug. 2005;115(8):2187-91.

Huh, M.I. et al. 2009, Distribution of TGF-$\beta$ isoforms and signaling intermediates in corneal fibrotic wound repair. J Cell Biochem. Oct. 1, 2009. 108(2): 476-88.

Hwang, K.J. et al.(1980), Hepatic uptake and degradation of unilamellar sphingomyelin/cholesterol liposomes: a kinetic study. Proc Natl Acad Sci U S A. Jul. 1980;77(7):4030-4.

Iredale, Models of liver fibrosis: exploring the dynamic nature of inflammation and repair in a solid organ, J.P. 2007. J Clin Invest. 117(3):539-48.

Janssens, K. et al.(2003), Transforming growth factor-beta 1 mutations in Camurati-Engelmann disease lead to increased signaling by altering either activation or secretion of the mutant protein. J Biol Chem. Feb. 28, 2003;278 (9):7718-24. Epub Dec. 18, 2002.

Jeong, et al., (2011). Suppression of innate immunity (natural killer cell/interferon-$\gamma$) in the advanced stages of liver fibrosis in mice. Hepatology. 53(4):1342-51.

Kasai, H. et al., 2005. TGF-beta1 induces human alveolar epithelial to mesenchymal cell transition (EMT). Respiratory Research. 6:56.

Katsimpardi, L. et al., Vascular and Neurogenic Rejuvintion of the Aging Mouse Brain by Young Systemic Factors, 2014. 344 (6184): 630-4, (Science Express. 10.1126/science.1251141).

Kim, H-M. et al., 1998. Inhibition of wound-induced expression of transforming growth factor-beta 1 mRNA by its antisense oligonucleotides. Pharmacol Res. 37(4):289-93.

Klampfl, et al., Somatic Mutations of Calreticulin in Myeloproliferative Neoplasms, 2013. NEJM 369:2379-90.

(56) References Cited

OTHER PUBLICATIONS

Koepke, M.L. et al., Nephroprotective effect of the HMG-CoA-reductase inhibitor cerivastatin in a mouse model of progressive renal fibrosis in Alport syndrome, 2007. Nephrol Dial Transplant. 22(4):1062-9.
Kohler, G. et al.(1975), Continuous cultures of fused cells secreting antibody of predefined specificity. Nature. Aug. 7, 1975;256(5517):495-7.
Kruisbeek, A.M. et al., 2004. Proliferative assays for T cell function. Cur Prot Immunol. Chapter 3:Unit 3.12.
Lacout, C. et al., JAK2V617F expression in murine hematopoietic cells leads to MPD mimicking human PV with secondary myelofibrosis, 2006. Blood. 108(5):1652-60.
Lee et al., Regulation of GDF-11 and myostatin activity by GASP-1 and GASP-2, 2013. PNAS. 110(39):E3713-22.
Lee, P-Y. et al., 2004. Electroporatic delivery of TGF-beta1 gene works synergistically with electric therapy to enhance diabetic wound healing in db/db mice. J Invest Dermatol. 123:791-8.
Lee, S-J. et al., Regulation of Muscle Mass by Follistatin and Activins, 2010. Mol Endocrinol. 24(10):1998-2008.
Lee., Extracellular Regulation of Myostatin: A Molecular Rheostat for Muscle Mass, 2010. Immunol Endocr Metab Agents Med Chem. 10:183-94.
Li, A. et al., 2004. Utilization of Ig heavy chain variable, diversity, and joining gene segments in children with B-lineage acute lymphoblastic leukemia: implications for the mechanisms of VDJ recombination and for pathogenesis. Blood. 103(12: 4602-9.
Ling, H. et al., Therapeutic Role of TGF-Neutralizing Antibody in Mouse Cyclosporin A Nephropathy: Morphologic Improvement Associated with Functional Preservation, 2003. J Am Soc Nephrol. 14:377-88.
Lissenberg-Thunnissen, S. N. et al.(2011) Use and efficacy of bone morphogenetic proteins in fracture healing. Int Orthop. Sep. 2011;35(9):1271-80.
Loffredo et al., Growth Differentiation Factor 11 Is a Circulating Factor that Reverses Age-Related Cardiac Hypertrophy, 2013. Cell. 153:828-39.
Ma et al. Role of CCR5 in IFN-g-induced and cigarette smoke-induced emphysema, 2005. J Clin Invest. 115:3460-72.
Ma, L.J. et al., Transforming Growth Factor-β-Dependent and -Independent Pathways of Induction of Tubulointerstitial Fibrosis in β−/− Mice, 2003. American Journal of Pathology. 163(4):1261-73.
Maheshwari et al., 2011. TGF-β2 suppresses macrophage cytokine production and mucosal inflammatory responses in the developing intestine. Gastroenterology. 140(1): 242-53.
Marcinkiewicz, C. et al. 2000, Inhibitory effects of MLDG-containing heterodimeric disintegrins reveal distinct structural requirements for interaction of the integrin α9β1 with VCAM-1, tenascin-C, and osteopontin. JBC. 2000. 275 (41):31930-7.
Martin, C.D. et al. 2006, A simple vector system to improve performance and utilisation of recombinant antibodies. BMC Biotechnol. 6:46.
Martin, F.J. et al.(1982), Irreversible coupling of immunoglobulin fragments to preformed vesicles. An improved method for liposome targeting. J Biol Chem. Jan. 10, 1982;257(1):286-8.
Marvin, J.S. et al., Recombinant approaches to IgG-like bispecific antibodies, 2005. Acta Pharmacologica Sinica. 26 (6):649-58.
Massague., How Cells Read TGF-β Signals (2000). Nature Reviews Molecular Cell Biology. 1:169-78.
Massignani, et al (2010), Cellular delivery of antibodies: effective targeted subcellular imaging and new therapeutic tool. Nature Proceedings, May 2010.
Matsuda, F. et al., 1998. The complete nucleotide sequence of the human immunoglobulin heavy chain variable region locus. The Journal of Experimental Medicine. 188(11); 2151-62.
McCafferty, et al., 1990. Phage antibodies: filamentous phage displaying antibody variable domains. Nature. 348:552-4.
McNaughton et al. Mammalian cell penetration, siRNA transfection, and DNA transfection by supercharged proteins (2009), Proc. Natl. Acad. Sci. USA 2009 106:6111-6116.
McPherron et al., Increasing muscle mass to improve metabolism, 2013. Adipocyte. 2(2):92-8.
Smith et al., Soluble Transforming Growth Factor-β Type II Receptor Inhibits Negative Remodeling, Fibroblast Transdifferentiation, and Intimal Lesion Formation But Not Endothelial Growth, 1999. Circ Res. 84(10):1212-22.
Staniszewska, I. et al. 2007, Integrin α9β1 is a receptor for nerve growth factor and other neurotrophins. Journal of Cell Science. 2007. 121(Pt 4):504-13.
Sumioka, T. et al. 2008, Inhibitory effect of blocking TGF-beta/Smad signal on injury-induced fibrosis of corneal endothelium. Mol Vis. 2008;14:2272-81. Epub Dec. 11, 2008.
Suragani, R.N.V.S. et al. 2014. Modified activin receptor IIB ligand trap mitigates ineffective erythropoiesis and disease complications in murine β-thalassemia. Blood. 123(25): 3864-72.
Suragani, R.N.V.S. et al. 2014. Transforming growth factor-β superfamily ligand trap ACE-536 corrects anemia by promoting late-stage erythropoiesis. Nature Medicine. 20(4): 408-17.
Takaki, et al. 2008. STAT6 Inhibits TGF-beta1-mediated Foxp3 induction through direct binding to the Foxp3 promoter, which is reverted by retinoic acid receptor. JBC. 283(22): 14955-62.
Takehara-Kasamatsu, Y. et al., Characterization of follistatin-related gene as a negative regulatory factor for activin family members during mouse heart development, 2007. J Med Invest. 54(3-4):276-88.
Thies, R.S. et al. 2001, GDF-8 propeptide binds to GDF-8 and antagonizes biological activity by inhibiting GDF-8 receptor binding. Growth Factors. 2001. 18:251-9.
Thomas, M. et al., Myostatin, a negative regulator of muscle growth, functions by inhibiting myoblast proliferation. 2000. J. Biol. Chem 275(51):40235-43.
Thrall, R.S. et al., Bleomycin-Induced Pulmonary Fibrosis in the Rat, 1979. Am J Pathol. 95:117-30.
Tran, D.Q. et al. 2009, GARP (LRRC32) is essential for the surface expression of latent TGF-β on platelets and activated FOXP3+ regulatory T cells. PNAS. Jun. 2, 2009 106(32):13445-50.
Tripathi, R.C. et al. 1994, Aqueous humor in glaucomatous eyes contains an increased level of TGF-β2. Exp Eye Res. Dec. 1994 59(6):723-7.
Tsai, V.W.W. et al., 2012. Anorexia/cachexia of chronic diseases: a role for the TGF-β family cytokine MIC-1/GDF15. J Cachexia Sarcopenia Muscle. 3:239-43.
Vannucchi, A.M. et al.,Develoment of myelofibrosis in mice genetically impaired for GATA-1 expression (GATA-1low Mice) 2002. Blood. 100(4):1123-32.
Vlahos, R. et al., Recent advances in pre-clinical mouse models of COPD, 2014. Clin Sci. 126:253-65.
Wan and Flavell (2005) Identifying Foxp3-expressing suppressor T cells with a bicistronic reporter. PNAS. 102(14): 5126-31.
Wang, A. et al. 1995, Expression of the integrin subunit α9 in the murine embryo. Developmental Dynamics. 1995. 204:421-31.
Wang, R. et al. (2012), GARP regulates the bioavailability and activation of TGFβ. Mol Biol Cell. Mar. 2012;23 (6):1129-39.
Wang, X-J. et al., 2006. Role of TGF beta-mediated inflammation in cutaneous wound healing. J Invest Derm Symp Proc. 11:112-7.
Wolfman, N.M. et al., Activation of latent myostatin by the BMP-1/tolloid family of metalloproteinases, PNAS. Oct. 6, 2003, 100(26):15842-6.
Wong, V.W. et al., 2011. Surgical approaches to create murine models of human wound healing. J Biomed Biotechnol. 2011:969618.
Xi, Y. et al., 2014. Inhibition of epithelial-to-mesenchymal transition and pulmonary fibrosis by methacycline. Am J Respir Cell Mol Biol. 50(1): 51-60.
Xu et al. Perlecan deficiency causes muscle hypertrophy, a decrease in myostatin expression, and changes in muscle fiber composition, 2010. Matrix Biol. 29(6):461-70.
Yamano, S. et al., 2013. Downregulated gene expression of TGF-βs in diabetic oral wound healing. J Craniomaxillofac Surg. 41(2):e42-8.
Yang et al. Absence of integrin-mediated TGFbeta1 activation in vivo recapitulates the phenotype of TGFbeta1-null mice. J Cell Biol 176: 787-793 (2007).

(56) References Cited

OTHER PUBLICATIONS

Yokasaki, Y. et al. 1998, Identification of the ligand binding site for the integrin α9β1 in the third fibronectin type III repeat of tenascin C. The Journal of Biological Chemistry. 1998. 273(19):11423-8.

Yokosaki, Y. et al. 1999, The integrin α9β1 binds to a novel recognition sequence (SVVYGLR) in the thrombin-cleaved amino-terminal fragment of osteopontin. JBC. 1999. 274(51):36328-34.

Yoon and Park, Ultrasound-mediated gene delivery (2010), Expert Opin Drug Deliv. 2010 7:321-330.

Yu, A.L. et al. 2010, TGF-β2 induces senescence-associated changes in human trabecular meshwork cells. Invest Ophthalmol Vis Sci. Nov. 2010 51(11): 5718-23.

Yu, Y. et al.(2012) Structural specializations of α(4)β(7), an integrin that mediates rolling adhesion. J Cell Biol. Jan. 9, 2012;196(1):131-46.

Zeisberg et al. 2003. BMP-7 counteracts TGF-beta1-induced epithelial-to-mesenchymal transition and reverses chronic renal injury. Nature Medicine. 9:964-8.

Zhang A.S. et al.(2010), Control of systemic iron homeostasis by the hemojuvelin-hepcidin axis. Adv Nutr. Nov. 2010;1 (1):38-45. Epub Nov. 16, 2010.

Zhang et al., 2009. Transforming growth factor-beta2 is a molecular determinant for site-specific melanoma metastasis in the brain. Cancer Res. 69(3): 828-35.

Zhu, J. et al., Relationship between Transforming Growth Factor-β1, Myostatin, and Decorin: Implications for Skeletal Muscle Fibrosis, 2007. J Biol Chem. 282:25852-63.

Penttinen et al. 2002. Secretion of hyman latent TGF-beta-binding protein-3 (LTBP-3) is dependent on co-expression of TGF-beta. J Cell Sci. 115(17): 3457-68.

Biswas et al. 2007. Inhibition of TGF-beta with neutralizing antibodies prevents radiation-induced acceleration of metastatic cancer progression. J Clin Invest 117(5): 1305-13.

International Search Report and Written Opinion, date of mailing: Dec. 5, 2015, from International Application No. PCT/US2014/036933, entitled "Compositions and Methods for Growth Factor Modulation."

Penttinen et al. "Secretion of human latent TGF-beta-binding protein-3 (LTBP-3) is dependent on co-expression of TGF-beta." J Cell Sci Sep. 1, 2002 vol. 115 pt 17 pp. 3457-3468.

Biswas et al. "Inhibition of TGF-beta with neutralizing antibodies prevents radiation-induced acceleration of metastatic cancer progression." J Clin Invest May 2007 vol. 117 No. 5 pp. 1305-1313.

GenBank NP_001123616.1 latent-transforming growth factor beta-binding protein 3 isoform 1 precursor [*Homo sapiens*] [online] Apr. 17, 2013 [retrieved Sep. 17, 2014]. Available on the internet: <URL: http://www.ncbi.nlm.nik.gov/protein/194328809?sat=17&satkey=24259765>.

Ames, R.S. et al. (1995), Conversion of murine Fabs isolated from a combinatorial phage display library to full length immunoglobulins. J Immunol Methods. Aug. 18, 1995;184(2):177-86.

Blobe, G.C. et al.(2000), Role of transforming growth factor beta in human disease. N Engl J Med. May 4, 2000;342 (18):1350-8.

Brinkmann, U. et al. (1995), Phage display of disulfide-stabilized Fv fragments. J Immunol Methods. May 11, 1995;182 (1):41-50.

Chao, G. et al.(2006), Isolating and engineering human antibodies using yeast surface display. Nat Protoc. 2006;1 (2):755-68.

Huston, J.S. et al.(1991), Protein engineering of single-chain Fv analogs and fusion proteins. Methods Enzymol. 1991;203:46-88.

Kettleborough, C.A. et al. (1994), Isolation of tumor cell-specific single-chain Fv from immunized mice using phage-antibody libraries and the re-construction of whole antibodies from these antibody fragments. Eur J Immunol. Apr. 1994,24(4):952-8.

Mascarenhas, J. et al., 2014. Anti-transforming growth factor-β therapy in patients with myelofibrosis. Leukemia and Lymphoma. 55:450-2.

Miersch, S. et al.(2012), Synthetic antibodies: Concepts, potential and practical considerations. Methods. Aug. 2012;57 (4):486-98.

Padlan, E.A.(1991), A possible procedure for reducing the immunogenicity of antibody variable domains while preserving their ligand-binding properties. Mol Immunol. Apr.-May 1991;28(4-5):489-98.

Pauluhn, J. et al. 2001. Rat model of lung fibrosis: comparison of functional, biochemical, and histopathological changes 4 months after single irradiation of the right hemithorax. Toxicology. 161:153-63.

Persic, L. et al.(1997), An integrated vector system for the eukaryotic expression of antibodies or their fragments after selection from phage display libraries. Gene. Mar. 10, 1997;187(1):9-18.

Proba et al., 1998, Antibody scFv fragments without disulfide bonds made by molecular evolution. J. Mol. Biol. 275:245-253.

Riechmann, L. et al.(1998), Reshaping human antibodies for therapy. Nature. Mar. 24, 1988;332(6162):323-7.

Roberts, S.N. et al. 1995. A novel model for human interstitial lung disease: hapten-driven lung fibrosis in rodents. J Pathol. 176(3):309-18.

Skerra, A. et al.(1988), Assembly of a functional immunoglobulin Fv fragment in *Escherichia coli*. Science. May 20, 1988;240(4855):1038-41.

Tanno et al., 2010. Growth differentiation factor 15 in erythroid health and disease. Curr Opin Hematol. 17(3):184-90.

Tsang, M. et al. 1995. Characterization of recombinant soluble human transforming growth factor-beta receptor type II (rhTGF-beta sRII). Cytokine 7(5):389-97.

Tutt, A. et al. (1991), Trispecific F(ab')3 derivatives that use cooperative signaling via the TCR/CD3 complex and CD2 to activate and redirect resting cytotoxic T cells. J Immunol. Jul. 1, 1991;147(1):60-9.

Verdine and Hilinski (2012), Stapled peptides for intracellular drug targets. Methods Enzymol. 2012. 503:3-33.

Wood and Sakaguchi, "Regulatory T Cells in Transplantation Tolerance," Nature Reviews, 2003.

Zhu et al., 1999, Extended half-life and elevated steady-state level of a single-chain Fv intrabody are critical for specific intracellular retargeting of its antigen, caspase-7. J. Immunol. Methods 231:207-222.

Mead, a.L. et al. 2003, Evaluation of anti-TGF-beta2 antibody as a new postoperative anti-scarring agent in glaucoma surgery. Invest Ophthalmol Vis Sci. Aug. 2003;44(8):3394-401.

Melidoni et al., 2013. Selecting antagonistic antibodies that control differentiation through inducible expression in embryonic stem cells. PNAS 110(44): 17802-7.

Meng, X.M. et al.(2010), Smad2 Protects against TGF-beta/Smad3-Mediated Renal Fibrosis. J Am Soc Nephrol. Sep. 2010;21(9):1477-87. Epub Jul. 1, 2010.

Mohammad, K.S. et al.(2009), Pharmacologic inhibition of the TGF-beta type I receptor kinase has anabolic and anti-catabolic effects on bone. PLoS One. 2009;4(4):e5275. Epub Apr. 16, 2008.

Morley. Sarcopenia in the elderly, 2012. Family Practice. 29:i44-i48.

Muenster et al 2011, Antagonism of Activin by Activin Chimeras, Vitam Horm. 2011 ; 85: 105-128.

Muir et al., Metalloproteinases in *Drosophila* to Humans That Are Central Players in Developmental Processes, 2011. J Biol Chem. 286(49):41905-11.

Mullally, A. et al., Physiological Jak2V617F Expression Causes a Lethal Myeloproliferative Neoplasm with Differential Effects on Hematopoietic Stem and Progenitor Cells, 2010. Cancer Cell. 17:584-96.

Nataatmadja et al., 2006. Overexpression of transforming growth factor-beta is associated with increased hyaluronan content and impairment of repair in Marfan syndrome aortic aneurysm. Circulation. 114(1 Suppl): 1371-7.

Nelson, A. L., Antibody fragments: hope and hype. MAbs.Jan.-Feb. 2010; 2(1):77-83.

Newman and Bettinger Gene therapy progress and prospects: Ultrasound for gene transfer (2007), Gene Ther. 2007 14:465-475.

Nials, A.T. et al., Mouse models of allergic asthma: acute and chronic allergen challenge, 2008. Disease Models and Mechanisms. 1:213-20.

Nikoloudis, D. et al., 2014. A complete, multi-level conformational clustering of antibody complementarity-determining regions. PeerJ. 2:e456.

(56) References Cited

OTHER PUBLICATIONS

Nistala, H. et al., 2010. Fibrillin-1 and -2 differentially modulate endogenous TGF-β and BMP bioavailability during bone formation. J Cell Biol. 190(6):1107-21.
O'Kane, S. et al., 1997. Transforming growth factor beta s and wound healing. Int J Biochem Cell Biol. 29(1):63-78.
Odenike, O., Beyond JAK inhibitor therapy in myelofibrosis, 2013. Hematology. 2013(1):545-52.
Oida, T. et al. 2010, TGF-β induces surface LAP expression on Murine CD4 T cells independent of FoxP3 induction. Plos One. 2010. 5(11):e15523.
Oklu, R. et al.(2000), The latent transforming growth factor beta binding protein (LTBP) family. Biochem J. Dec. 15, 2000;352 Pt 3:601-10.
Oliva et al. An automated classification of the structure of protein loops., (1997), J. Mol Biol 266 (4): 814-830; 1997.
Oommen, S. et al. 2011, Vacular endothelial growth factor A (VEGF-A) induces endothelial and cancer cell migration through direct binding to integrin α9β1. JBC. 2011. 286(2):1083-92.
Ouhtit et al., 2013. TGF-β2: A Novel Target of CD44-Promoted Breast Cancer Invasion. J Cancer. 4(7):566-72.
Palmer E.L. et al., 1993, Sequence and tissue distribution of the integrin α9 subunit, a novel partner of β1 that is widely distributed in epithelia and muscle. Journal of Cell Biology. 1993. 123(5):1289-97.
Papanikolauou et al., 2004, Mutations in HFE2 cause iron overload in chromosome 1q-linked juvenile hemochromatosis, Nature Genetics, 36:77-82.
Paulson, RF. 2014. Targeting a new regulator of erythropoiesis to alleviate anemia. Nature Medicine. 20:334-5.
Pershad, K. et al., 2010. Generating a panel of highly specific antibodies to 20 human SH2 domains by phage display. Protein Engineering Design and Selection. 23:279-88.
Picht, G. et al 2001., Transforming growth factor beta 2 levels in the aqueous humor in different types of glaucoma and the relation to filtering bleb development. Graefes Arch Clin Exp Ophthalmol. Mar. 2001 239(3):199-207.
Pigeon, C. et al.(2001), A new mouse liver-specific gene, encoding a protein homologous to human antimicrobial peptide hepcidin, is overexpressed during iron overload. J Biol Chem. Mar. 16, 2001;276(11):7811-9. Epub Dec. 11, 2000.
Pitella et al. Enhanced endosomal escape of siRNA-incorporating hybrid nanoparticles from calcium phosphate and PEG-block chargeconversional polymer for efficient gene knockdown with negligible cytotoxicity, (2011), Biomaterials. 2011 32:3106-3114.
Postema and Gilja, Ultrasound-directed drug delivery (2007), Curr Pharm Biotechnol. 2007 8:355-361.
Preusch et al., GDF-15 protects from macrophage accumulation in a mousemodel of advanced atherosclerosis, 2013. Eur J Med Res. 18:19.
Rautava et al., 2011, TGF-β2 induces maturation of immature human intestinal epithelial cells and inhibits inflammatory cytokine responses induced via the NF-κB pathway, Pediatr Gastroenterol Nutr. May 2012 ; 54(5): 630-638.
Reed et al., 1994. Expression of transforming growth factor-beta 2 in malignant melanoma correlates with the depth of tumor invasion. Implications for tumor progression. Am J Pathol. 145(1): 97-104.
Riethmuller, G. Symmetry breaking: bispecific antibodies, the beginnings, and 50 years on, 2012. Cancer Immunity. 12:12-18.
Rodino-Klapac, L.R. et al.(2009), Inhibition of myostatin with emphasis on follistatin as a therapy for muscle disease. Muscle Nerve. Mar. 2009;39(3):283-96.
Roetto et al., 2003, Mutant antimicrobial peptide hepcidin is associated with severe juvenile hemochromatosis, Nature genetics, 33:21-22.
Roguska, M.A. et al.(1994), Humanization of murine monoclonal antibodies through variable domain resurfacing. Proc Natl Acad Sci U S A. Feb. 1, 1994;91(3):969-73.
Rozema et al., Dynamic PolyConjugates for targeted in vivo delivery of siRNA to hepatocytes, Proc Natl Acad Sci U S A. 2007 104:12982-12887.

Santibanez, J.F. et al.(2011), TGF-beta/ TGF-beta receptor system and its role in physiological and pathological conditions. Clin Sci (Lond). Sep. 2011;121(6):233-51.
Sato-Nishiuchi, R. et al. 2012, Polydom/SVEP1 is a ligand for integrin α9β1. JBC. 2012. 287(30):25615-30.
Schaefer, D.W. et al., Antifibrotic activities of pirfenidone in animal models, 2011. Eur Respir Rev. 20: 120, 85-97.
Schaefer, W. et al., Immunoglobulin domain crossover as a generic approach for the production of bispecific IgG antibodies, 2011. PNAS. 108(27):11187-92.
Schlingensiepen et al., 2008, Antisense Therapeutics for Tumor Treatment: The TGF-beta2 Inhibitor AP 12009 in Clinical Development Against Malignant Tumors, Recent Results in Cancer Research, vol. 177, 137-150.
Schofield, D. et al., 2007. Application of phage display to high throughput antibody generation and characterization. Genome Biol. 8, R254.
Sengle et al., A New Model for Growth Factor Activation: Type II Receptors Compete with the Prodomain for BMP-7, 2008. J Mol Biol. 381(4):1025-39.
Sengle et al., Prodomains of Transforming Growth Factor β (TGFβ) Superfamily Members Specify Different Functions Extracellular Matrix Interactions and Growth Factor Bioavailability, 2011. J Biol Chem. 286 (7):5087-99.
Sherwood, J.K. et al., Controlled antibody delivery systems. Nature Biotechnology. 1992. 10:1446-9.
Shi, M. et al. (2011), Latent TGF-β structure and activation. Nature. Jun. 15, 2011; 474(7351):343-9.
Shu, L. et al.(1993), Secretion of a single-gene-encoded immunoglobulin from myeloma cells. Proc Natl Acad Sci U S A. Sep. 1, 1993;90(17):7995-9.
Siegwart et al. Combinatorial synthesis of chemically diverse coreshell nanoparticles for intracellular delivery, (2011), Proc Natl Acad Sci U S A. 2011 108:12996-13001.
Sinha, M. et al., Restoring Systemic GDF11 Levels Reverses Age-Related Dysfunction in Mouse Skeletal Muscle, 2014. 344(6184);649-52 (Science Express. 10.1126/science.1251152, p. 2-6 ).
Taylor, R.G. et al., 1985. Histopathologic features of phorbol myristate acetate-induced lung injury. Lab Invest. 52 (1):61-70.
Studnicka, G.M. et al.(1994), Human-engineered monoclonal antibodies retain full specific binding activity by preserving non-CDR complementarity-modulating residues. Protein Eng. Jun. 1994;7(6):805-14.
Abe, M. et al. (1994), An assay for transforming growth factor-beta using cells transfected with a plasminogen activator inhibitor-1 promoter-luciferase construct. Anal Biochem. Feb. 1, 1994;216(2):276-84.
Alderson, K.L. et al., "Clinical Cancer Therapy by NK Cells via Antibody-Dependent Cell-Mediated Cytotoxicity," 2011 J Biomed Biotechnol. 2011:379123.
Altschul, S. F. et al., "Basic Local Alignment Search Tool," (1990), J. Molec. Biol., 215, 403 (1990).
Anderson et al.,"Identification of a Novel Pool of Extracellular Promyostatin in Skeletal Muscle," 2008. J Biol Chem. 283(11):7027-35).
Andersson, E.R. et al.(2011), Notch signaling: simplicity in design, versatility in function. Development. Sep. 2011;138 (17):3593-612.
Andre et al. "Nucleic acids electrotransfer in vivo: mechanisms and practical aspects," (2010), Curr Gene Ther. 2010 10:267-280.
Andriopoulos, B. Jr. et al.(2009), BMP6 is a key endogenous regulator of hepcidin expression and iron metabolism. Nat Genet. Apr. 2009;41(4):482-7. Epub Mar. 1, 2009.
Aoki, F. et al.(2007), Therapeutic potential of follistatin to promote tissue regeneration and prevent tissue fibrosis. Endocr J. Dec. 2007;54(6):849-54. Epub Oct. 15, 2007.
Arany, P.R. et al., 2014. Photoactivation of Endogenous Latent Transforming Growth Factor-β1 Directs Dental Stem Cell Differentiation for Regeneration. Sci Transl Med 6, 238ra69.
Aurigemma, "Diastolic Heart Failure—A Common and Lethal Condition by Any Name," 2006. N Engl J Med. 355 (3):308-10.

(56) References Cited

OTHER PUBLICATIONS

Babitt et al., 2007. Modulation of bone morphogenetic protein signaling in vivo regulates systemic iron balance. J Clin Invest. 117(7):1933-9.

Bazigou, E. et al. 2009, Integrin-α9 is required for fibronectin matrix assembly during lymphatic valve morphogenesis. Dev Cell. Aug. 2009. 17(2):175-86.

Benoit et al. Synthesis of folate-functionalized RAFT polymers for targeted siRNA delivery (2011), Biomacromolecules. 2011 12:2708-2714.

Bilezikjian et al 2012, Cell-Type Specific Modulation of Pituitary Cells by Activin, Inhibin and Follistatin, Mol Cell Endocrinol. Aug. 15, 2012; 359(1-2): 43-52.

Biocca, et al., Expression and targeting of intracellular antibodies in mammalian cells. EMBO J. 9: 101-108, 1990.

Bogdahn et al., 2010. Targeted therapy for high-grade glioma with the TGF-β2 inhibitor trabedersen: results of a randomized and controlled phase IIb study. Neuro Oncol. 13(1) 132-42.

Boileau et al., TGFB2 mutations cause familial thoracic aortic aneurysms and dissections associated with mild systemic features of Marfan syndrome, Nature Genetics Letters. 2012. 44(8):916-23.

Bradbury, A.R. et al.(2011), Beyond natural antibodies: the power of in vitro display technologies. Nat Biotechnol. Mar. 2011;29(3):245-54.

Caron et al. Intracellular Delivery of a Tat-eGFP Fusion Protein into Muscle Cells(2011), Mol. Ther. 3(3):310-8 (2001).

Carpenter et al., 2010. Osteoblastic differentiation of human and equine adult bone marrow-derived mesenchymal stem cells when BMP-2 or BMP-7 homodimer genetic modification is compared to BMP-2/7 heterodimer genetic modification in the presence and absence of dexamethasone. J Orthop Res. 28(10):1330-7.

Carrancio, S. et al., 2014. An activin receptor IIA ligand trap promotes erythropoiesis resulting in a rapid induction of red blood cells and haemoglobin. Br J Haematol. 165(6):870-82.

Carrington, L.M. et al.2006, Differential regulation of key stages in early corneal wound healing by TGF-beta isoforms and their inhibitors. Invest Ophthalmol Vis Sci. May 2006;47(5):1886-94.

Cash, J.N et al. 2009, The structure of myostatin:follistatin 288: insights into receptor utilization and heparin binding. The EMBO Journal. 2009. 28:2662-76.

Ceco, E. 2013. Modifying muscular dystrophy through transforming growth factor-β. FEBS J. 280(17):4198-209.

Chagraoui, H. et al., Prominent role of TGF-β1 in thrombopoietin-induced myelofibrosis in mice, 2002. Blood. 100 (10):3495-503ββ.

Chen et al. Conversion of peripheral CD4+CD25- naive T cells to CD4+CD25+ regulatory T cells by TGF-beta induction of transcription factor Foxp3. JEM 198 (12): 1875-1886 (2003).

Chesnoy, S. et al., 2003. Intradermal injection of transforming growth factor-beta1 gene enhances wound healing in genetically diabetic mice. Pharmaceutical Research. 20(3):345-50.

Clevers, H. et al.(2012), Wnt/β-catenin signaling and disease. Cell. Jun. 8, 2012;149(6):1192-205.

Coin, P.G. et al., 1996. Pulmonary fibrogenesis after three consecutive inhalation exposures to chrysotile asbestos. Am J Respir Crit Care Med. 154(5):1511-9.

Collison, L.W. et al., 2011. In vitro Treg suppression assays. Methods Mol Biol. 707:21-37.

Cronican et al. Potent Delivery of Functional Proteins into Mammalian Cells in Vitro and in Vivo Using a Supercharged Protein, (2010), ACS Chem. Biol. 2010 5:747-752.

Czajkowsky, D.M. et al., Fc-fusion proteins: new developments and future perspectives, 2012. EMBO Mol Med. 4 (10):1015-28.

Daopin, S. et al. 1992, Crystal structure of transforming growth factor-β2: an unusual fold for the superfamily. Science. 1992. 257(5068):369-73.

Daugherty, et al. (2006), Formulation and delivery issues for monoclonal antibody therapeutics. Adv Drug Deliv Rev. Aug. 7, 2006;58(5-6):686-706.

Davis, Comparative Study of Inhibition at Multiple Stages of Amyloid- Self-Assembly Provides Mechanistic Insight (2010), Mol Pharm. 2009 6:659-668.

Davis, Evidence of RNAi in humans from systemically administered siRNA via targeted nanoparticles (2010), Nature 2010 464:1067-1070.

Demidova-Rice, T. et al., 2012. Acute and impaired wound healing: pathophysiology and current methods for drug delivery, part 2: role of growth factors in normal and pathological wound healing: therapeutic potential and methods of delivery. Adv Skin Wound Care. 25(8):349-70.

Denicourt, C. et al. (2003), Another twist in the transforming growth factor β-induced cell-cycle arrest chronicle. PNAS. 2003. 100(26):15290-1.

Devereux, J., A comprehensive set of sequence analysis programs for the VAX (1984), et al., Nucleic Acids Research, 12(1), 387 (1984)).

Edwards, B.M. et al., 2003. The remarkable flexibility of the human antibody repertoire; isolation of over one thousand different antibodies to a single protein, BLyS. JMB. 334: 103-18.

El-Andaloussi et al. Cell-penetrating peptides: mechanisms and applications (2003), Curr. Pharm. Des. 11 (28):3597-611 (2003).

Eppstein (1985), D.A. et al., Biological activity of liposome-encapsulated murine interferon gamma is mediated by a cell membrane receptor. Proc Natl Acad Sci U S A. Jun. 1985;82(11):3688-92.

Falk, R. et al., 2012. Generation of anti-Notch antibodies and their application in blocking Notch signalling in neural stem cells. Methods. 58: 69-78.

Fantini, M.C. et al., 2007. In vitro generation of CD4+ CD25+ regulatory cells from murine naive T cells. Nature Protocols. 2(7):1789-94.

Finkenstedt et al., Regulation of iron metabolism through GDF15 and hepcidin in pyruvate kinase deficiency, The, 2008. British Journal of Haematology. 144:789-93.

Fujii, T. et al., RMeseoaruchs aerti cmle odel of carbon tetrachloride induced liver fibrosis: Histopathological changes and expression of CD133 and epidermal growth factor, 2010. BMC Gastroenterology. 10:79.

Fuller et al., Subtilisin-like Proprotein Convertase Expression, Localization, and Activity in the Human Retina and Optic Nerve Head (2009). Invest Ophthalmol Vis Sci. 50(12):5759-68.

Gardenghi et al., Hepcidin as a therapeutic tool to limit iron overload and improve anemia in β-thalassemic mice, 2010, JCI. 120(12):4466-77.

Ge et al., GDF11 Forms a Bone Morphogenetic Protein 1-Activated Latent Complex That Can Modulate Nerve Growth Factor-Induced Differentiation of PC12 Cells, 2005. Mol Cell Biol. 25(14):5846-58.

Govani, F.S. et al.(2009), Hereditary haemorrhagic telangiectasia: a clinical and scientific review. Eur J Hum Genet. Jul. 2009;17(7):860-71. Epub Apr. 1, 2009.

International Preliminary Report on Patentability, International Application No. PCT/US2014/036933, dated Nov. 19, 2015.

Stockis, J. et al. "Membrane protein GARP is a receptor for latent TGF-beta on the surface of activated human Treg." Eur J. Immunol. Dec. 2009;39(12):3315-22.

Shi, Minlong, et al. "Latent TGF-β structure and activation", Nature, vol. 474, No. 7351, Jun. 15, 2011, pp. 343-349.

European Search Report for EP application No. 13853885.5 dated May 13, 2016.

Japanese Office Action for JP application No. 2015-540878 dated Apr. 26, 2016.

Figure 5

An embodiment of a recombinant GPC

- C-terminus
- Disulfide bond
- Growth factor domain
- Proprotein convertase cleavage site
- Latency-associated peptide (LAP)
- Cys residue → HS  SH
- N-terminus
- Histidine tags

Figure 6

An embodiment of a proprotein convertase cleavage site mutant (e.g. RXXR → RXG; D2G)

An embodiment of an N-terminal cysteine mutant (e.g. C4S: Cys4→Ser)

```
                    Latency lasso      α2
                         110        120    ↓    130           140           150
TGFB1hu      42 ~~~~~~~~GPLPEAVLALYNSTRDRVAGESAEPE~~~~~~~~~~~~~~~~~~~~~~ 67
TGFB1cyno    42 ~~~~~~~~GPLPEAVLALYNSTRDRVAGESAEPE~~~~~~~~~~~~~~~~~~~~~~ 67
TGFB1mu      42 ~~~~~~~~GPLPEAVLALYNSTRDRVAGESADPE~~~~~~~~~~~~~~~~~~~~~~ 67
TGFB1po      42 ~~~~~~~~GPLPEAVLALYNSTRDRVAGESVEPE~~~~~~~~~~~~~~~~~~~~~~ 67
TGFB2        41 ~~~~~~~~PEEVPPEVISIYNSTRDLLQEKASRRA~~~~~~~~~~~~~~~~~~~~~~ 67
TGFB3        41 ~~~~~~~~VMTFVPYQVLALYNSTRELLEEMHGERE~~~~~~~~~~~~~~~~~~~~~ 68
GDF11        83 ~~~~~~~~APPLQQILDLHDFQGDALQPEDFLEE~~~~~~~~~~~~~~~~~~~~~~ 108
GDF11mu      81 ~~~~~~~~APPLQQILDLHDFQGDALQPEDFLEE~~~~~~~~~~~~~~~~~~~~~~ 106
GDF8         61 ~~~~~~~~APPLRELIDQYDVQRDSSDGSLED~~~~~~~~~~~~~~~~~~~~~~~~ 85
GDF8cyno     61 ~~~~~~~~APPLRELIDQYDVQRDSSDGSLED~~~~~~~~~~~~~~~~~~~~~~~~ 85
GDF8mu       61 ~~~~~~~~APPLRELIDQYDVQRDSSDGSLED~~~~~~~~~~~~~~~~~~~~~~~~ 85
InhBetaA     61 ~~~~~~~~AALLNAIRKLHVGKVGENGYVEIED~~~~~~~~~~~~~~~~~~~~~~~ 85
InhAlphaA    37 ~~~~~~~~~~~~~~VRRLPRRALGGFTHRGSEP~~~~~~~~~~~~~~~~~~~~~~~ 56
BMP9         66 ~~~~~~~~~~~~~~YMIDLYNRYTSDKSTT~~~~~~~~~~~~~~~~~~~~~~~~~~ 81
BMP2         48 ~~~~~~~RDAVVPPYMLDLYRRESGQPGSPAPDHR~~~~~~~~~~~~~~~~~~~~~~ 79
BMP4         56 ~~~~~~~KSAVIPDYMRDLYRLQSGEEEEEQIHST~~~~~~~~~~~~~~~~~~~~~~ 83
BMP7         43 ~~LQGKH~NSAPHFMLDLYNAMAV~~~EEGGGPGGQGFSYPYKAVFS~~~~~~ 83
BMP6        103 EPPPGRL~KSAPLFMLDLYNALSADNDEDGASEGERQQSWPHEAASSSQRRQ 153
BMP8         44 PPAASRLPASAPLFMLDLYRAMAGDDDEDGAPAE~~~~~~~~~~~~~~~~~ 77
LEFTY1       35 ~~~~~~~~~~HVRAQYVALLQRSHGDRSRGKRFSQS~~~~~~~~~~~~~~~~~~~~~ 68

Fastener β1
                         160        170        180        190        200
TGFB1hu      68 ~~~~~~~~~~~~~~~~~~~~~~~~~~~~PEPEAD~YYAKEVTRVLMV~~~ETH 88
TGFB1cyno    68 ~~~~~~~~~~~~~~~~~~~~~~~~~~~~PEPEAD~YYAKEVTRVLMV~~~ETH 88
TGFB1mu      68 ~~~~~~~~~~~~~~~~~~~~~~~~~~~~PEPEAD~YYAKEVTRVLMV~~~DRN 88
TGFB1po      68 ~~~~~~~~~~~~~~~~~~~~~~~~~~~~PEPEAD~YYAKEVTRVLMV~~~ESG 88
TGFB2        68 ~~~~~~~~~~~~~~~~~~~~~~~AACERERSDEE~YYAKEVYKIDMPPFFPSE 96
TGFB3        69 ~~~~~~~~~~~~~~~~~~~~~~~EGCTQENTESE~YYAKEIHKFDMIQGLAEH 97
GDF11       109 ~~~~~~~~~~~~~~~~~~~~~~~~~~~~~~D~EYHATTETVISMAQETDF 127
GDF11mu     107 ~~~~~~~~~~~~~~~~~~~~~~~~~~~~~~D~EYHATTETVISMAQETDF 125
GDF8         86 ~~~~~~~~~~~~~~~~~~~~~~~~~~~~~~D~DYHATTETIITMPTESDF 104
GDF8cyno     86 ~~~~~~~~~~~~~~~~~~~~~~~~~~~~~~D~DYHATTETIITMPTESDF 104
GDF8mu       86 ~~~~~~~~~~~~~~~~~~~~~~~~~~~~~~D~DYHATTETIITMPTESDF 104
InhBetaA     86 ~~~~~~~~~~~~~~~~~~~~~~~~~~~~~~GIGRRAEHNELMEQTSEIIT 105
InhAlphaA    57 ~~~~~~~~~~~~~~~~~~~~~~~~~~~~~~~EEEDVSQAILFPATDAS 74
BMP9         82 ~~~~~~~~~~~~~~~~~~~~~~~~~~~~~~~~PASNIVRSFSMEDAI 96
BMP2         76 ~~~~~~~~~~~~~~~~~~~~~~~~~~LE~RAASRANTVRSFHHEESL 95
BMP4         84 ~~~~~~~~~~~~~~~~~~~~~~~~GLEYPE~RPASRANTVRSFHHEEHL 107
BMP7         84 ~~~~~~~~~~~~~~~~~~~TQGPPLASLQDS~HFLTDADHVKSFVHLVEH 113
BMP6        154 PPPGAAEFLRKRSLLAPGSGSGGASPLTSAQDS~AFLSDADHVKSFVHLVEY 204
BMP8         78 ~~~~~~~~~~~~~~~~~~~~~~~~~~~QRLGRADLVKSFVNMVER 95
LEFTY1       61 ~~~~~~~~~~~~~~~~~~~~~~~~~~~~FREVAGRFLALE~~ 72
```

Figure 8C

```
                              β2          α3              β3
                 210       220       230        240        250        260
                  |         |         |          |          |          |
TGFB1hu     89 NEIYDKFKQS-----THSIYMFFNTSEL-REAVPEPVLLSRAELRLLR---- 130
TGFB1cyno   89 NEIYDKFKQS-----THSIYMFFNTSEL-REAVPEPVLLSRAELRLLR---- 130
TGFB1mu     89 NAIYEKTKDI-----SHSIYMFFNTSDI-REAVPEPPLLSRAELRLQR---- 130
TGFB1po     89 NQIYDKFKGT-----PHSLYNLFNTSEL-REAVPEPVLLSRAELRLLR---- 130
TGFB2       97 NAIPPTFYR------PYFRIVRFDVSAM-EKNASN---LVKAEFRVFR---- 134
TGFB3       98 NELAVCPKG------ITSKVFRFNVSSV-EKNRTN---LFRAEFRVLR---- 135
GDF11      128 AVQTD----------GSPLCCHFHFSPK-VMFTK----VLKAQLWVYL---- 160
GDF11mu    126 AVQTD----------GSPLCCHFHFSPK-VMFTK----VLKAQLWVYL---- 158
GDF8       105 LMQVD----------GKPKCCFFKFSSK-IQYNK----VVKAQLWIYL---- 137
GDF8cyno   105 LMQVD----------GKPKCCFFKFSSK-IQYNK----VVKAQLWIYL---- 137
GDF8mu     105 LMQAD----------GKPKCCFFKFSSK-IQYNK----VVKAQLWIYL---- 137
InhBetaA   106 PAESG----------TARRTLRFEISKEGSDLSV----VERAEVWLFL---- 139
InhAlphaA   75 CEDKSAARGLAQEAEEGLFRYMFRPSQH-TRSRQ----VTSAQLWFHT---- 117
BMP9        97 SITATEDFP------FQKHILLFNIS-I-PRHEQ----ITRAELRLYV---- 132
BMP2        96 EELPETSG-------KTTRRFFFNLSSI-PTEEF----ITSAELQVFR---- 131
BMP4       108 ENIPGTSE-------NSAFRFLFNLSSI-PENEV----ISSAELRLFR---- 143
BMP7       114 DKEFFPRR-------YHREFRFDLSKI-PEGEA-----VTAAEFRIYK---- 149
BMP6       205 DKEFSPRQ-------RHHKEFRFNLSQI-PEGEV----VTAAEFRIYK---- 240
BMP8        96 DRALGHQE-------PHWKEFRFDLTQI-PAGEA----VTAAEFRIYK---- 131
LEFTY1      73 ---------------ASTHLLVFGMEQR-LPPNSE---LVQAVLRLFQEPVP 105

β4                         β5
                  270        280        290        300       310
                   |          |          |          |         |
TGFB1hu    131 -----------LKLRVEQHVELYQKYSNN--------SW--------RYLS 154
TGFB1cyno  131 -----------LKLRVEQHVELYQKYSNN--------SW--------RYLS 154
TGFB1mu    131 -----------LKSSVEQHVELYQKYSNN--------SW--------RYLG 154
TGFB1po    131 -----------LKLRVEQHVELYQKYSND--------SW--------RYLS 154
TGFB2      135 --------LQNPKARVPEQRIELYQILKSKD--LT---SPTQ------RYID 167
TGFB3      136 --------VPNPSSKRNEQRIELFQILRPDE--HI---AKQ-------RYIG 167
GDF11      161 --------RPVPRPATVYLQILRL-KPLT-GEG------TAGGGGGRRHIR 196
GDF11mu    159 --------RPVPRPATVYLQILRL-KPLT-GEG------TAGGGGGRRHIR 194
GDF8       138 --------RPVETPTTVFVQILRLIKPMK--DG---------T------RYTG 165
GDF8cyno   138 --------RPVETPTTVFVQILRLIKPMK--DG---------T------RYTG 165
GDF8mu     138 --------RPVKTPTTVFVQILRLIKPMK--DG---------T------RYTG 165
InhBetaA   140 --------KVPRANRTRTKVTIRLFQQQKHPQG------S---------LDTG 169
InhAlphaA  118 --GLDRQGTAASNSSEPLLGLLALSPG-----------------G-----PVAV 147
BMP9       133 --SCQNHVDPSHDLKGSVVIYDVLDGTD--AWDSATETK--------TFLV 171
BMP2       132 --EQMDALGNNSSFHHRINIYEIIKPAT--AN-SKFPVT--------RLLD 170
BMP4       144 --EQVDQGPDWERGF-ERINIYEVMKPPA--EVVPGHLIT-------RLLD 182
BMP7       150 -----DYIRERFDNETFRISVYQVLQEHL--GR--ESDL---------FLLD 183
BMP6       241 -----DCVMGSFKNQTFLISIYQVLQEHQ--NR--DSDL---------FLLD 274
BMP8       132 ------VPSIELLNRTLHVSMNFQVVQEQS--NR--ESDL---------FFLD 164
LEFTY1     106 KAALHREGRLSPRSARARVTVEWLRVRDD--GS-----NRT---------SLID 143
```

Figure 8D

```
                                β5              β6         α4
                              ━━━━━         ━━━━━━━   ━━━━━━━━
                       320         330         340         350         360
                       ....|....|....|....|....|....|....|....|....|....|
TGFB1hu     155 ~~~~~~~~~~~~~~~~~~NRLLA~~~PSDSPEWLSFDVTGVVRQWLSRGG~~EI 185
TGFB1cyno   155 ~~~~~~~~~~~~~~~~~~NRLLA~~~PSDSPEWLSFDVTGVVRQWLSRGG~~EI 185
TGFB1mu     155 ~~~~~~~~~~~~~~~~~~NRLLT~~~PTDTPEWLSFDVTGVVRQWLNQGD~~EI 185
TGFB1po     155 ~~~~~~~~~~~~~~~~~~NRLLA~~~PSDSPEWLSFDVTGVVRQWLTRRE~~AI 185
TGFB2       168 ~~~~~~~~~~~~~~~~~~SKVVK~~~TRAEGEWLSFDVTDAVHEWLHHKD~~RN 198
TGFB3       168 ~~~~~~~~~~~~~~~~~~GKNLP~~~TRGTAEWLSFDVTDTVREWLLRRE~~SN 198
GDF11       197 ~~~~~~~~~~~~~~~~~~IRSLKIELHSRSGHWQSIDFKQVLHSWFRQPQ~~SN 230
GDF11mu     195 ~~~~~~~~~~~~~~~~~~IRSLKIELHSRSGHWQSIDFKQVLHSWFRQPQ~~SN 228
GDF8        166 ~~~~~~~~~~~~~~~~~~IRSLKLDMNPGTGIWQSIDVKTVLQNWLKQPE~~SN 199
GDF8cyno    166 ~~~~~~~~~~~~~~~~~~IRSLKLDMNPGTGIWQSIDVKTVLQNWLKQPE~~SN 199
GDF8mu      166 ~~~~~~~~~~~~~~~~~~IRSLKLDMNPGTGIWQSIDVKTVLQNWLKQPE~~SN 199
InhBetaA    170 EEAEEVGLKGERSELLLSEKVVDARKST~~NHVFPYSSSIQKLLDQGK~~SS 217
InhAlphaA   148 ~~~~~~~~~~~~~~~~~~PHSLG~~~~~HAPPHWAVLHLATSALSLLTHPV~~LV 177
BMP9        172 ~~~~~~~~~~~~~~~~~~SQDIQD~~~~~EGWETLEVSSAVKRWVRSDSTKSK 201
BMP2        171 ~~~~~~~~~~~~~~~~~~TRLVN~~~~QNASRWESFDVTPAVRRWTAQGH~~AN 200
BMP4        183 ~~~~~~~~~~~~~~~~~~TRLVN~~~~HNVTRWETFDVSPAVLRWTREKQ~~PN 212
BMP7        184 ~~~~~~~~~~~~~~~~~~SRTLR~~~~ASEEGWLVFDITATSNHWVVNPR~~HN 213
BMP6        279 ~~~~~~~~~~~~~~~~~~TRVVR~~~~ASEEGWLEFDITATSNLWVVTPQ~~HN 304
BMP8        165 ~~~~~~~~~~~~~~~~~~LQTLR~~~~AGDEGWLVDVTAASDCWLLKRH~~KD 194
LEFTY1      144 ~~~~~~~~~~~~~~~~~~SRLVS~~~~~VHESGWKAFDVTEAVNFWQQLSRPRQP 175

β7          Bowtie                                    Bowtie
              ━━━━━         ━━━━                                      ━━
               β7            β8                                        β9
              ━━━━━         ━━━━                                      ━━
                 370           380         390         400         410
                 ....|....|....|....|....|....|....|....|....|....|
TGFB1hu     186 EGPRL~~SARCSCDSRD~~~~~~~~~~~~~~~~~~~~~~~~~~NTLQ 294
TGFB1cyno   186 EGPRL~~SARCSCDSKD~~~~~~~~~~~~~~~~~~~~~~~~~~NTLQ 294
TGFB1mu     186 QGPRF~~SARCSCDSKD~~~~~~~~~~~~~~~~~~~~~~~~~~NKLH 294
TGFB1po     186 EGPRL~~SARCSCDSKD~~~~~~~~~~~~~~~~~~~~~~~~~~NTLH 294
TGFB2       199 LGFKI~~SLRCPCCTFVPSN~~~~~~~~~~~~~~~~~~~NYIIPNKSEELS 229
TGFB3       199 LGLEI~~SIRCPCRTFQP~N~~~~~~~~~~~~~~~~~~~GDILENIHEVMS 227
GDF11       231 WGIEI~~NAFDPSGTDLAVT~~~~~~~~~~~~~~~~~~~SLG~~~~~~~~~~ 251
GDF11mu     229 WGIEI~~NAFDPSGTDLAVT~~~~~~~~~~~~~~~~~~~SLG~~~~~~~~~~ 249
GDF8        200 LGIEI~~KALDENGHDLAVT~~~~~~~~~~~~~~~~~~~FPG~~~~~~~~~~ 220
GDF8cyno    200 LGIEI~~KALDENGHDLAVT~~~~~~~~~~~~~~~~~~~FPG~~~~~~~~~~ 220
GDF8mu      200 LGIEI~~KALDENGHDLAVT~~~~~~~~~~~~~~~~~~~FPG~~~~~~~~~~ 220
InhBetaA    218 LDVRIACEQCQESGASLVLLGKKKKEEEGEGKKKGGGEGGAG~~~~~~ 260
InhAlphaA   178 LLLRC~~PLCTCSA~~~~~~~~~~~~~~~~~~~~~~~~~~~~~~~~~~~~ 189
BMP9        202 NKLEV~~TVE~~~~~~~~~~~~~~~~~~~~~~~~~~~~~~~~~~~~~~~~ 209
BMP2        201 HGFVV~~EVAHLEEKQGVSK~~~~~~~~~~~~~~~~~~~~~~~~~~~~~~ 218
BMP4        213 YGLAI~~EVTHLEQTRTHQG~~~~~~~~~~~~~~~~~~~~~~~~~~~~~~ 230
BMP7        214 LGLQL~~SVETLDGQSINPK~~~~~~~~~~~~~~~~~~~LAGL~~~~~~~~ 235
BMP6        305 MGLQL~~SVVTRDGVRVHPR~~~~~~~~~~~~~~~~~~~AAGL~~~~~~~~ 326
BMP8        195 LGLRL~~YVETEDGKSVDPG~~~~~~~~~~~~~~~~~~~LAGL~~~~~~~~ 216
LEFTY1      176 LLLQV~~SVQREHLGPLASG~~~~~~~~~~~~~~~~~~~AHKLV~~~~~~~ 198
```

```
                         α1              β1    β2    α2              β3   β4
TGFB1hu    250 ~~ALDTNYCFSSTEKNCCVRQLYIDFRKDLGW~K~WIHEPKGYHANFCLGPC 297
TGFB1cyno  250 ~~ALDTNYCFSSTEKNCCVRQLYIDFRKDLGW~K~WIHEPKGYHANFCLGPC 297
TGFB1mu    250 ~~ALDTNYCFSSTEKNCCVRQLYIDFRKDLGW~K~WIHEPKGYHANFCLGPC 297
TGFB1po    250 ~~ALDTNYCFSSTEKNCCVRQLYIDFRKDLGW~K~WIHEPKGYHANFCLGPC 297
TGFB2      264 ~~ALDAAYCFRNVQDNCCLRPLYIDFKRDLGW~K~WIHEPKGYNANFCAGAC 311
TGFB3      281 ~~ALDTNYCFRNLEENCCVRPLYIDFRQDLGW~K~WVHEPKGYYANFCSGPC 328
GDF11      275 ~~NLGLDCDEHSSESRCCRYPLTVDFE~AFGW~~DWIIAPKRYKANYCSGQC 321
GDF11mu    273 ~~NLGLDCDEHSSESRCCRYPLTVDFE~AFGW~~DWIIAPKRYKANYCSGQC 319
GDF8       244 ~~DFGLDCDEHSTESRCCRYPLTVDFE~AFGW~~DWIIAPKRYKANYCSGEC 290
GDF8cyno   244 ~~DFGLDCDEHSTESRCCRYPLTVDFE~AFGW~~DWIIAPKRYKANYCSGEC 290
GDF8mu     244 ~~DFGLDCDEHSTESRCCRYPLTVDFE~AFGW~~DWIIAPKRYKANYCSGEC 290
InhBetaA   291 ~~~~GLECDGK~VNICCKKQ~FFVSFK~DIGW~NDWIIAPSGYHANYCEGEC 334
InhAlphaA  228 LRLLQRPPEEPAAHANCHRVALNISFQ~ELGW~ERWIVYPPSFIFHYCHGGC 277
BMP9       289 GSTLARRKRSAGAGSHCQKTSLRVNFE~DIGW~DSWIIAPKEYEAYECKGGC 338
BMP2       260 ~~~QAKHKQRKRLKSSCKRHPLYVDFS~DVGW~NDWIVAPPGYHAFYCHGEC 306
BMP4       274 ~SPKHHSQRARKKNKNCRRHSLYVDFS~DVGW~NDWIVAPPGYQAFYCHGDC 322
BMP7       286 MAN~VAENSSSDQRQACKKHELYVSFR~DLGW~QDWIIAPEGYAAYYCHGEC 334
BMP6       377 VSS~ASDYNSSELKTACRKHELYVSFQ~DLGW~QDWIIAPKGYAANYCDGEC 425
BMP8       266 LPGIFDDVRGSHGRQVCRRHELYVSFQ~DLGW~LDWVIAPQGYSAYYCEGEC 315
LEFTY1     230 ~~~~CDPEAPMTEGTRCCRQEMYIDLQ~GMKWAENWVLEPPGFLAYECVGTC 276

β5      β6
TGFB1hu    298 PYIWSLD~~~TQYSKVLALYNQ~~~~~H~~~N~PGASAAPCC~~VPQALEPLP 336
TGFB1cyno  298 PYIWSLD~~~TQYSKVLALYNQ~~~~~H~~~N~PGASAAPCC~~VPQALEPLP 336
TGFB1mu    298 PYIWSLD~~~TQYSKVLALYNQ~~~~~H~~~N~PGASASPCC~~VPQALEPLP 336
TGFB1po    298 PYIWSLD~~~TQYSKVLALYNQ~~~~~H~~~N~PGASAAPCC~~VPQALEPLP 336
TGFB2      312 PYLWSSD~~~TQHSRVLSLYNT~~~~~I~~~N~PEASASPCC~~VSQDLEPLT 370
TGFB3      329 PYLRSAD~~~TTHSTVLGLYNT~~~~~L~~~N~PEASASPCC~~VPQDLEPLT 367
GDF11      322 EYMFMQKYPHT~~~~~~HLVQQ~~~~~A~~~R~PRGSAGPCC~~TPTKMSPIN 357
GDF11mu    320 EYMFMQKYPHT~~~~~~HLVQQ~~~~~A~~~R~PRGSAGPCC~~TPTKMSPIN 355
GDF8       291 EFVFLQKYPHT~~~~~~HLVEQ~~~~~A~~~N~PRGSAGPCC~~TPTKMSPIN 326
GDF8cyno   291 EFVFLQKYPHT~~~~~~HLVEQ~~~~~A~~~N~PRGSAGPCC~~TPTKMSPIN 326
GDF8mu     291 EFVFLQKYPHT~~~~~~HLVEQ~~~~~A~~~N~PRGSAGPCC~~TPTKMSPIN 326
InhBetaA   335 PSHIAGTSGSS~LSFHSTVINHYRMRGH~~~S~PFANLKSCC~~VPTKLRPMS 380
InhAlphaA  278 GLEIPPRLSLPVPGAPPTPAQP~~~~~~Y~~~S~LLPGAQPCCAALPGTMRPLH 321
BMP9       339 FFPLADDVTPTKHAIVQTLVHL~~~~~K~~~F~PTKVGKACC~~VPTKLSPIS 380
BMP2       307 PFPLADHLNSTNHAIVQTLVNS~~~~~V~~~~~NSKIPKACC~~VPTELSAIS 347
BMP4       323 PFPLADHLNSTNHAIVQTLVNS~~~~~V~~~~~NSSIPKACC~~VPTELSAIS 363
BMP7       335 AFPLNSYMNATNHAIVQTLVHF~~~~~I~~~N~PETVPKPCC~~APTQLNAIS 376
BMP6       426 SFPLNAHMNATNHAIVQTLVHL~~~~~H~~~N~PEYVPKPCC~~APTKLNAIS 467
BMP8       316 SFPLDSCMNATNHAILQSLVHL~~~~~M~~~K~PNAVPKACC~~APTKLSATS 357
LEFTY1     277 RQPPEAL~~~~~~~~~~~~~~~~~~~~~~~~~~AFKWPFLGPRQC~~~IASETDSLP 304
```

Figure 8G

```
                    β6           β7          β8
                  ━━━━━      ━━━━━━━━━     ━━━━
                    630        640          650         660
TGFB1hu     337  IVYYVG----RKPKVEQLSNMIVRSCKCS~~~~~~~~~~~~~~  361
TGFB1cyno   337  IVYYVG----RKPKVEQLSNMIVRSCKCS~~~~~~~~~~~~~~  361
TGFB1mu     337  IVYYVG----RKPKVEQLSNMIVRSCKCS~~~~~~~~~~~~~~  361
TGFB1po     337  IVYYVG----RKPKVEQLSNMIVRSCKCS~~~~~~~~~~~~~~  361
TGFB2       371  ILYYIG----KTPKIEQLSNMIVKSCKCS~~~~~~~~~~~~~~  395
TGFB3       368  ILYYVG----RTPKVEQLSNMVVKSCKCS~~~~~~~~~~~~~~  392
GDF11       358  MLYFNDK---QQIIYGKIPGMVVDRCGCS~~~~~~~~~~~~~~  383
GDF11mu     356  MLYFNDK---QQIIYGKIPGMVVDRCGCS~~~~~~~~~~~~~~  381
GDF8        327  MLYFNGK---EQIIYGKIPAMVVDRCGCS~~~~~~~~~~~~~~  352
GDF8cyno    327  MLYFNGK---EQIIYGKIPAMVVDRCGCS~~~~~~~~~~~~~~  352
GDF8mu      327  MLYFNGK---EQIIYGKIPAMVVDRCGCS~~~~~~~~~~~~~~  352
InhBetaA    381  MLYYDDG---QNIIKKDIQNMIVEECGCS~~~~~~~~~~~~~~  406
InhAlphaA   322  VRTTSDGG--YSFKYETVPNLLTQHCACI~~~~~~~~~~~~~~  348
BMP9        381  VLYKDDM---GVPTLKYHYEGMSVAECGCR~~~~~~~~~~~~~  407
BMP2        348  MLYLDE----NEKVVLKNYQDMVVEGCGCR~~~~~~~~~~~~~  373
BMP4        364  MLYLDE----YDKVVLKNYQEMVVEGCGCR~~~~~~~~~~~~~  389
BMP7        377  VLYFDD----SSNVILKKYRNMVVRACGCH~~~~~~~~~~~~~  402
BMP6        468  VLYFDD----NSNVILKKYRNMVVRACGCH~~~~~~~~~~~~~  493
BMP8        358  VLYYDS----SNNVILRKHRNMVVKACGCH~~~~~~~~~~~~~  383
LEFTY1      305  MIVSIKEGGRTRPQVVSLPNMRVQKCSCASDGALVPRRLQP    345
```

Figure 9A

|         | TGFB1hu | TGFB1po | TGFB2 | TGFB3 | GDF11 | GDF8 | InhBeta | InhAlph | BMP9 | BMP2 | BMP4 | BMP7 | BMP6 | BMP8 | LEFTY1 |
|---------|---------|---------|-------|-------|-------|------|---------|---------|------|------|------|------|------|------|--------|
| TGFB1hu | 100     | 94      | 42    | 46    | 19    | 22   | 16      | 14      | 14   | 19   | 18   | 18   | 16   | 17   | 15     |
| TGFB1po | 94      | 100     | 42    | 46    | 20    | 22   | 15      | 14      | 14   | 19   | 19   | 18   | 15   | 17   | 15     |
| TGFB2   | 42      | 42      | 100   | 55    | 18    | 20   | 13      | 12      | 13   | 21   | 19   | 18   | 15   | 16   | 15     |
| TGFB3   | 46      | 46      | 55    | 100   | 19    | 21   | 14      | 13      | 14   | 19   | 18   | 20   | 17   | 19   | 14     |
| GDF11   | 19      | 20      | 18    | 19    | 100   | 61   | 21      | 15      | 15   | 18   | 18   | 17   | 18   | 16   | 13     |
| GDF8    | 22      | 22      | 20    | 21    | 61    | 100  | 24      | 14      | 16   | 20   | 18   | 18   | 17   | 19   | 12     |
| InhBetaA| 16      | 15      | 13    | 14    | 21    | 24   | 100     | 12      | 15   | 18   | 18   | 17   | 15   | 19   | 9      |
| InhAlphaA| 14     | 14      | 12    | 13    | 15    | 14   | 12      | 100     | 14   | 11   | 12   | 13   | 10   | 13   | 11     |
| BMP9    | 14      | 14      | 13    | 14    | 15    | 16   | 15      | 14      | 100  | 24   | 25   | 21   | 20   | 21   | 11     |
| BMP2    | 19      | 19      | 21    | 19    | 18    | 20   | 18      | 11      | 24   | 100  | 59   | 26   | 23   | 25   | 15     |
| BMP4    | 18      | 19      | 19    | 18    | 18    | 18   | 18      | 12      | 25   | 59   | 100  | 25   | 24   | 26   | 14     |
| BMP7    | 18      | 18      | 18    | 20    | 17    | 18   | 17      | 13      | 21   | 26   | 25   | 100  | 54   | 50   | 12     |
| BMP6    | 16      | 15      | 15    | 17    | 18    | 17   | 15      | 10      | 20   | 23   | 24   | 54   | 100  | 42   | 11     |
| BMP8    | 17      | 17      | 16    | 19    | 16    | 19   | 19      | 13      | 21   | 25   | 26   | 50   | 42   | 100  | 12     |
| LEFTY1  | 15      | 15      | 15    | 14    | 13    | 12   | 9       | 13      | 11   | 15   | 14   | 12   | 11   | 12   | 100    |

Figure 9B

|          | TGFB1hu | TGFB1po | TGFB2 | TGFB3 | GDF11 | GDF8 | InhBetaA | InhAlphaA | BMP9 | BMP2 | BMP4 | BMP7 | BMP6 | BMP8 | LEFTY1 |
|----------|---------|---------|-------|-------|-------|------|----------|-----------|------|------|------|------|------|------|--------|
| TGFB1hu  | 100     | 100     | 83    | 86    | 48    | 47   | 44       | 34        | 36   | 43   | 44   | 44   | 46   | 41   | 32     |
| TGFB1po  | 100     | 100     | 83    | 86    | 48    | 47   | 44       | 34        | 36   | 43   | 44   | 44   | 46   | 41   | 32     |
| TGFB2    | 83      | 83      | 100   | 89    | 50    | 49   | 47       | 37        | 37   | 47   | 47   | 48   | 49   | 46   | 30     |
| TGFB3    | 86      | 86      | 89    | 100   | 50    | 49   | 46       | 36        | 36   | 47   | 46   | 46   | 50   | 44   | 30     |
| GDF11    | 48      | 48      | 50    | 50    | 100   | 94   | 52       | 37        | 45   | 47   | 44   | 50   | 50   | 45   | 29     |
| GDF8     | 47      | 47      | 49    | 49    | 94    | 100  | 51       | 34        | 44   | 47   | 44   | 49   | 50   | 45   | 27     |
| InhBetaA | 44      | 44      | 47    | 46    | 52    | 51   | 100      | 40        | 47   | 53   | 52   | 55   | 56   | 52   | 27     |
| InhAlphaA| 34      | 34      | 37    | 36    | 37    | 34   | 40       | 100       | 40   | 41   | 39   | 42   | 42   | 39   | 26     |
| BMP9     | 36      | 36      | 37    | 36    | 45    | 44   | 47       | 40        | 100  | 60   | 56   | 56   | 59   | 57   | 28     |
| BMP2     | 43      | 43      | 47    | 47    | 47    | 47   | 53       | 41        | 60   | 100  | 88   | 69   | 71   | 68   | 30     |
| BMP4     | 44      | 44      | 47    | 46    | 44    | 44   | 52       | 39        | 56   | 88   | 100  | 66   | 66   | 67   | 29     |
| BMP7     | 44      | 44      | 48    | 46    | 50    | 49   | 55       | 42        | 56   | 69   | 66   | 100  | 90   | 78   | 29     |
| BMP6     | 46      | 46      | 49    | 50    | 50    | 50   | 56       | 42        | 59   | 71   | 66   | 90   | 100  | 81   | 30     |
| BMP8     | 41      | 41      | 46    | 44    | 45    | 45   | 52       | 39        | 57   | 68   | 67   | 78   | 81   | 100  | 31     |
| LEFTY1   | 32      | 32      | 30    | 30    | 29    | 27   | 27       | 26        | 28   | 30   | 29   | 29   | 30   | 31   | 100    |

Figure 9C

| | TGFB1hu | TGFB1po | TGFB2 | TGFB3 | GDF11 | GDF8 | InhBetaA | InhAlphaA | BMP9 | BMP2 | BMP4 | BMP7 | BMP6 | BMP8 | LEFTY1 |
|---|---|---|---|---|---|---|---|---|---|---|---|---|---|---|---|
| TGFB1hu | 100 | 92 | 30 | 34 | 14 | 17 | 10 | 10 | 9 | 14 | 14 | 13 | 11 | 13 | 13 |
| TGFB1po | 92 | 100 | 31 | 35 | 15 | 17 | 10 | 11 | 10 | 14 | 14 | 13 | 10 | 13 | 13 |
| TGFB2 | 30 | 31 | 100 | 46 | 13 | 16 | 7 | 8 | 8 | 17 | 14 | 13 | 10 | 11 | 14 |
| TGFB3 | 34 | 35 | 46 | 100 | 13 | 16 | 9 | 9 | 9 | 15 | 14 | 15 | 11 | 14 | 11 |
| GDF11 | 14 | 15 | 13 | 13 | 100 | 50 | 16 | 12 | 9 | 12 | 13 | 11 | 10 | 13 | 13 |
| GDF8 | 17 | 17 | 16 | 16 | 50 | 100 | 19 | 11 | 9 | 13 | 13 | 11 | 10 | 13 | 11 |
| InhBetaA | 10 | 10 | 7 | 9 | 16 | 19 | 100 | 9 | 10 | 10 | 11 | 9 | 8 | 11 | 8 |
| InhAlphaA | 10 | 11 | 8 | 9 | 12 | 9 | 9 | 100 | 11 | 8 | 9 | 10 | 7 | 11 | 11 |
| BMP9 | 9 | 10 | 8 | 9 | 9 | 10 | 9 | 11 | 100 | 16 | 17 | 13 | 12 | 13 | 10 |
| BMP2 | 14 | 14 | 17 | 15 | 12 | 13 | 10 | 8 | 16 | 100 | 49 | 17 | 14 | 16 | 14 |
| BMP4 | 14 | 14 | 14 | 14 | 13 | 13 | 11 | 9 | 17 | 49 | 100 | 17 | 16 | 17 | 13 |
| BMP7 | 13 | 13 | 13 | 15 | 11 | 11 | 9 | 10 | 13 | 17 | 17 | 100 | 46 | 43 | 11 |
| BMP6 | 11 | 10 | 10 | 11 | 12 | 10 | 8 | 7 | 12 | 14 | 16 | 46 | 100 | 34 | 8 |
| BMP8 | 13 | 13 | 11 | 14 | 10 | 13 | 11 | 11 | 13 | 16 | 17 | 43 | 34 | 100 | 9 |
| LEFTY1 | 13 | 13 | 14 | 11 | 13 | 11 | 8 | 11 | 10 | 14 | 13 | 11 | 8 | 9 | 100 |

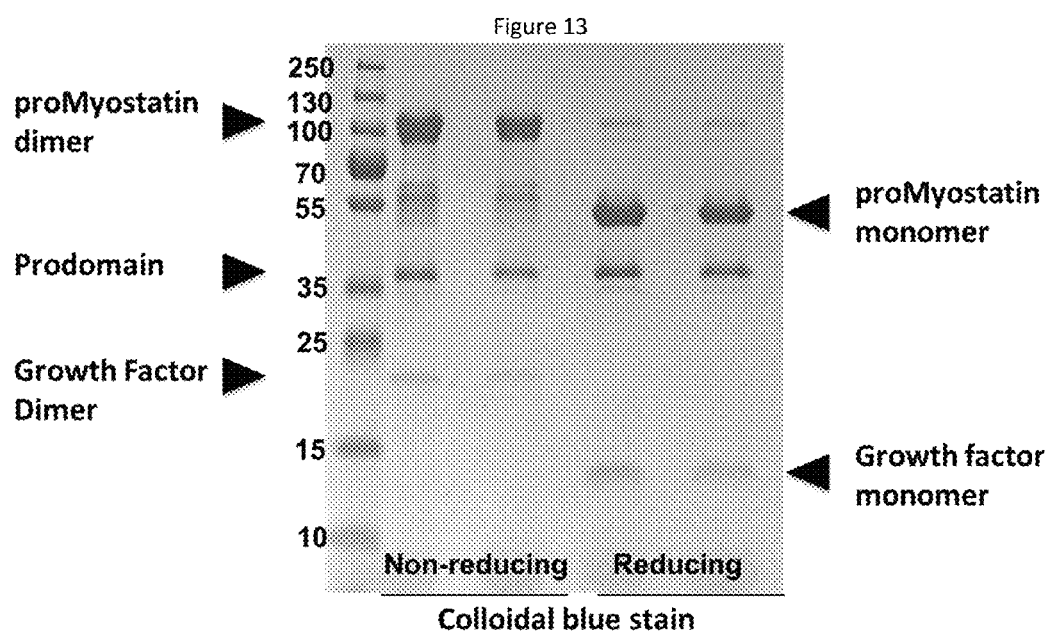

COMPOSITIONS AND METHODS FOR GROWTH FACTOR MODULATION

CROSS REFERENCE TO RELATED APPLICATIONS

This application is a continuation of International Application No. PCT/US2014/36933, filed May 6, 2014 entitled Compositions and Methods for Growth Factor Modulation, which claims priority to U.S. Provisional Patent Application No. 61/819,840 filed May 6, 2013, entitled Compositions and Methods for Growth Factor Modulation, U.S. Provisional Patent Application No. 61/823,552 filed May 15, 2013, entitled Compositions and Methods for Growth Factor Modulation and U.S. Provisional Patent Application No. 61/900,438 filed Nov. 6, 2013, entitled Compositions and Methods for Growth Factor Modulation, the contents of each of which are herein incorporated by reference in their entireties.

SEQUENCE LISTING

The instant application contains a Sequence Listing which has been submitted electronically in ASCII format and is hereby incorporated by reference in its entirety. Said ASCII copy, created on Jul. 9, 2015, is named 2035_1001USCON4_SL.txt and is 705,429 bytes in size.

FIELD OF THE INVENTION

Embodiments of the present invention may include recombinant proteins as well as antibodies directed to such proteins. In some embodiments, such proteins and antibodies may be related to the field of TGF-β family member biology.

BACKGROUND OF THE INVENTION

Cell signaling molecules stimulate a variety of cellular activities. Such signaling is often tightly regulated, often through interactions with other biomolecules, the extracellular and/or cellular matrix or within a particular cell environment or niche. Such interactions may be direct or indirect.

Cell signaling cascades are involved in a number of diverse biological pathways including, but not limited to modulation of cell growth, modulation of tissue homeostasis, extracellular matrix (ECM) dynamics, modulation of cell migration, invasion and immune modulation/suppression. In some cases, proteins involved in cell signaling are synthesized and/or are sequestered in latent form, requiring stimulus of some kind to participate in signaling events. There remains a need in the art for agents, tools and methods for modulating cell signaling and/or cellular activities.

SUMMARY OF THE INVENTION

In some embodiments, the present invention provides recombinant proteins comprising one or more TGF-β-related proteins comprising one or more protein modules selected from the group consisting of growth factor prodomain complexes (GPCs), latency associated peptides (LAPs), LAP-like domains, straight jacket regions, growth factor domains, fastener regions, furin cleavage site regions, arm regions, fingers regions, N-terminal regions for extracellular associations, latency loops, alpha 1 helical regions, alpha 2 helical regions, RGD sequence regions, trigger loop regions and bowtie regions. In some embodiments, recombinant proteins of the present invention may comprise one or more protein modules from a vertebrate species. In some embodiments, recombinant proteins of the present invention may comprise one or more protein modules comprising one or more mutations. In some embodiments, recombinant proteins of the present invention may comprise one or more mutations comprising one or more furin cleavage site regions. In some embodiments, such mutations may prevent enzymatic cleavage of recombinant proteins of the present invention. In some embodiments, recombinant proteins of the present invention may comprise one or more mutations comprising a mutation of the amino acid sequence RXXR to the amino acid sequence RXG. In some embodiments, recombinant proteins of the present invention may comprise one or more mutations comprising a mutation of the amino acid sequence RXXR to the amino acid sequence AXXA. In some embodiments, recombinant proteins of the present invention may comprise one or more mutations comprising N-terminal regions for extracellular associations. In some embodiments, recombinant proteins of the present invention may comprise one or more mutations comprising substitution and/or deletion of at least one cysteine residue present within about the first 4, 5, 6 or 7 N-terminal amino acid residues. In some embodiments, recombinant proteins of the present invention may comprise one or more substitution of at least one cysteine residue with at least one serine residue.

In some embodiments, recombinant proteins of the present invention may be complexed with a protein selected from the group consisting of LTBP1, LTBP1S, LTBP2, LTBP3, LTBP4, fibrillin-1, fibrillin-2, fibrillin-3, fibrillin-4, GARP, LRRC33 and a combination or fragment thereof. In some embodiments, recombinant proteins of the present invention may comprise one or more detectable labels. Such detectable labels may comprise biotin labels, polyhistidine tags and/or flag tags.

In some embodiments, the present invention provides chimeric proteins comprising one or more protein modules from at least two TGF-β-related proteins wherein said protein modules may be selected from the group consisting of growth factor prodomain complexes (GPCs), latency associated peptides (LAPs), LAP-like domains, straight jacket regions, growth factor domains, fastener regions, furin cleavage site regions, arm regions, fingers regions, N-terminal regions for extracellular associations, latency loops, alpha 1 helical regions, RGD sequence regions, trigger loop regions, bowtie regions and any of those listed in Tables 2, 3 and 11. In some embodiments, chimeric proteins of the present invention may comprise one or more protein modules selected from one or more vertebrate species. In some embodiments, chimeric proteins of the present invention may comprise GPCs. In some embodiments, such GPCs may comprise at least one LAP or LAP-like domain from a TGF-β family member and at least one growth factor domain from a TGF-β family member wherein the LAP or LAP-like domain and the growth factor domain are from different TGF-β family members. In some embodiments, chimeric proteins of the present invention may comprise at least one LAP or LAP-like domain and at least one growth factor domain, each of which is selected from the group consisting of TGF-β1, TGF-β2, TGF-β3, GDF-8, GDF-11 and inhibin beta A. In some embodiments, chimeric proteins of the present invention may comprise one or more GPC wherein at least one N-terminal region is from a TGF-β family member, at least one C-terminal region is from a TGF-β family member and wherein the N-terminal region and C-terminal region are from different TGF-β family members. In some embodiments, chimeric proteins of the present invention may comprise at least one N-terminal region and at least one C-terminal region selected from TGF-β1 terminal regions, TGF-β2 terminal regions, TGF-β3 terminal regions, GDF-8 terminal regions, GDF-11 terminal regions and inhibin beta A terminal regions. In some embodiments, chimeric proteins of the present invention may comprise a GPC from at least one TGF-β family member comprising at least one arm region from a different TGF-β family member. In some embodiments, chimeric proteins of the present invention may comprise a GPC comprising at least one TGF-β family member comprising at least one trigger loop region from a different TGF-β family member. In some embodiments, chimeric protein of the present invention may comprise any of the protein module combinations listed in Table 12.

In some embodiments, chimeric protein of the present invention may be complexed with a protein selected from the group consisting of LTBP1, LTBP1S, LTBP2, LTBP3, LTBP4, fibrillin-1, fibrillin-2, fibrillin-3, fibrillin-4, GARP and LRRC33 and a combination or fragment thereof. In some embodiments, chimeric proteins of the present invention may comprise one or more detectable labels. In some embodiments, such detectable labels may comprise at least one biotin label, polyhistidine tag and/or flag tag.

In some embodiments, the present invention provides an antibody directed to any of the recombinant proteins and/or chimeric proteins disclosed herein. In some embodiments, such antibodies comprise monoclonal antibodies. In some embodiments, antibodies of the present invention are substantially isolated. In some embodiments, monoclonal antibodies of the present invention are stabilizing antibodies. In some embodiments, stabilizing antibodies of the present invention reduce the level of free growth factor relative to the level of growth factor associated with one or more GPC. In some embodiments, stabilizing antibodies may reduce growth factor-dependent cellular signaling. In some embodiments, monoclonal antibodies of the present invention may comprise releasing antibodies. Such antibodies may increase the level of free growth factor relative to the level of growth factor associated with one or more GPC. In some embodiments, releasing antibodies of the present invention may increase growth factor-dependent cellular signaling.

In some embodiments, the present invention provides compositions comprising one or more of any of the recombinant proteins, one or more of any of the chimeric proteins and/or one or more of any of the antibodies described herein combined with at least one excipient.

In some embodiments, the present invention provides methods of modulating the level of free growth factor in a subject or cell niche comprising the use of one or more compositions described herein. In some such methods, the level of growth factor signaling is modulated.

In some embodiments, the present invention provides methods for selecting a desired antibody comprising the use of one or more assays, wherein such assays comprise one or more recombinant protein of the invention. Some such methods comprise the steps of 1) providing an antibody binding assay, 2) contacting the binding assay with one or more candidate antibodies, 3) obtaining binding data related to candidate antibody affinity for the one or more recombinant protein and 4) selecting a desired antibody based on the binding data. Binding assays according to such methods may include an enzyme-linked immunosorbent assay (ELISA) and/or a fluorescence-associated cell sorting (FACS)-based assay. In some cases, recombinant proteins of such assays may be complexed with a protein selected from the group consisting of SEQ ID NOs: 153-161 and 286-292 or complexed with a protein selected from the group consisting of LTBP1, LTBP1S, LTBP2, LTBP3, LTBP4, fibrillin-1, fibrillin-2, fibrillin-3, fibrillin-4, GARP, LRRC33, perlecan, decorin, elastin and collagen. In some cases, recombinant proteins may comprise a chimeric protein comprising an amino acid sequence selected from the group consisting of SEQ ID NOs: 199-236 and 273.

Other methods of selecting a desired antibody may comprise the steps of 1) providing a growth factor activity assay, 2) contacting the growth factor activity assay with one or more candidate antibodies, 3) obtaining growth factor activity data and 4) selecting a desired antibody based on the growth factor activity data. Growth factor activity assays according to such methods may comprise cell-based assays selected from the group consisting of luciferase-based assays and proliferation assays. Such cell-based assays may comprise one or more expression cells that express one or more recombinant protein of the invention or a complex thereof. Such assays may further comprise one or more responsive cells that yield gene expression data and/or viability data.

In some embodiments, the present invention provides pharmaceutical compositions comprising one or more of any of the recombinant proteins described herein, one or more of any of the chimeric proteins described herein and/or one or more of any of the antibodies described herein and at least one pharmaceutically excipient.

Some methods of the invention comprise treatment of a TGF-β-related indication in a subject comprising contacting said subject with a composition of the invention. TGF-β-related indications may include fibrotic indications (e.g. lung fibrosis, kidney fibrosis, liver fibrosis, cardiovascular fibrosis, skin fibrosis, and bone marrow fibrosis), myelofibrosis, cancer or cancer-related conditions (e.g. colon cancer, renal cancer, breast cancer, malignant melanoma and glioblastoma) and muscle disorders and/or injuries [e.g. cachexia, muscular dystrophy, chronic obstructive pulmonary disease (COPD), motor neuron disease, trauma, neurodegenerative disease, infection, rheumatoid arthritis, immobilization, sarcopenia, inclusion body myositis and diabetes.]

In some embodiments, the invention provides a kit comprising a composition of the invention and instructions for use thereof.

BRIEF DESCRIPTION OF THE FIGURES

The foregoing and other objects, features and advantages will be apparent from the following description of particular embodiments of the invention, as illustrated in the accompanying drawings. The drawings are not necessarily to scale, emphasis instead being placed upon illustrating the principles of various embodiments of the invention.

FIG. 5 is a schematic of an embodiment of a recombinant GPC.

FIG. 6 is a schematic of embodiments of mutant recombinant GPCs.

Figure 8A:
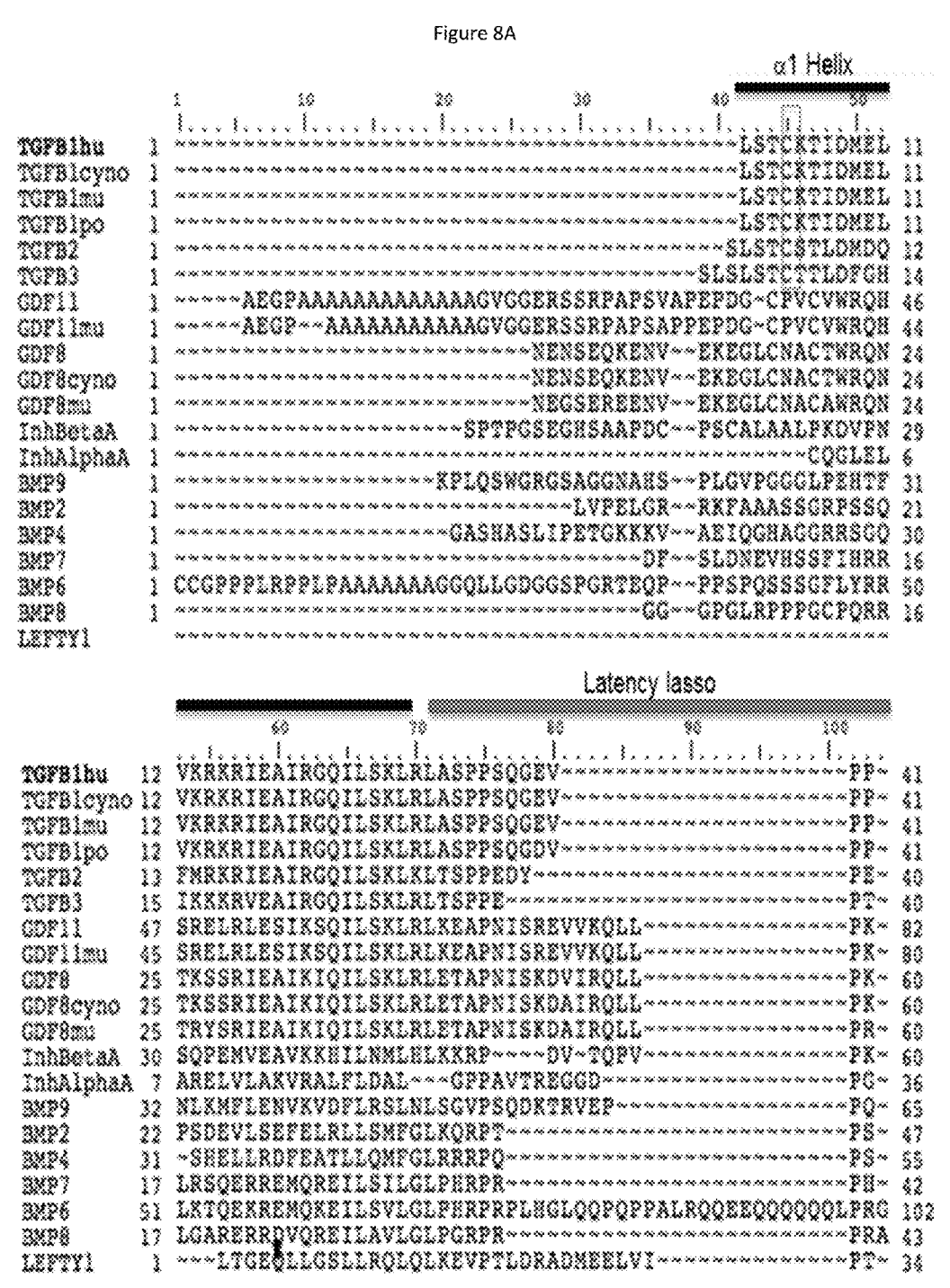
Figure 8E:
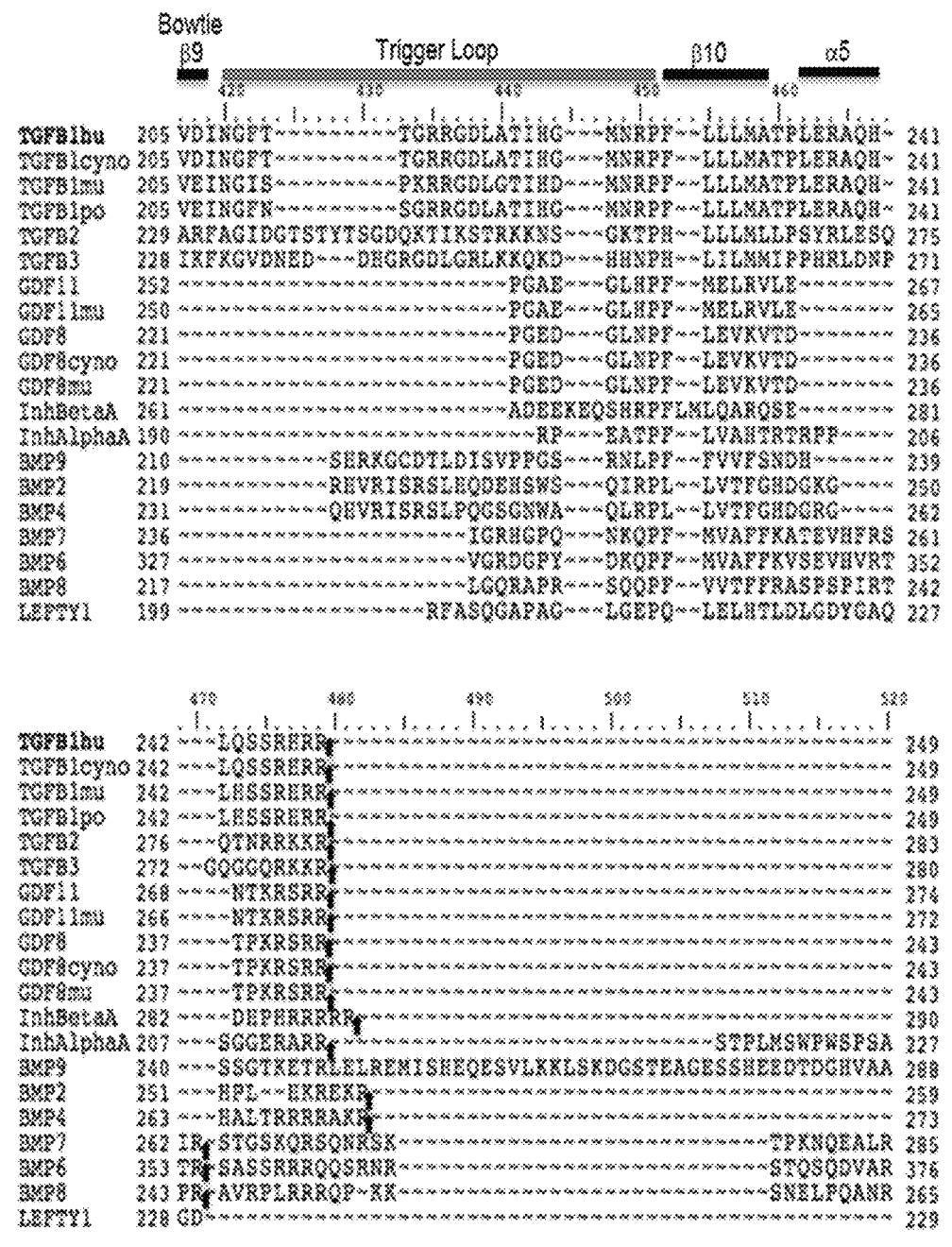

FIGS. 8A-8G show structure-based alignment between TGF-β family member proteins (SEQ ID NOS 1, 117, 116, 296, 2-4, 137, 5, 131, 125, 6, 14, 21, 23-24, 27, 26, 28, and 10, respectively, in order of appearance) [adapted from Shi et al (Shi, M. et al., *Latent TGF-β structure and activation*. Nature. 2011 Jun. 15; 474(7351):343-9, the contents of which are herein incorporated by reference in their entirety.)] Cysteine residues required for interaction with LTBPs and/or GARPs are boxed. Residues mutated in Camurati-Engelmann syndrome are indicated with a star. Protease cleavage sites are indicated with an up arrow. Protein modules and secondary structural elements are indicated with solid bars. Residues underlined at the N-terminus of GDF-8 correspond to alternatively predicted signal peptide processing sites. "Chimeric module breakpoints" indicate regions where structural features are conserved and provide modules for chimeric protein construction (swapping of modules between family members) in all family members. N-terminal regions are shown in FIGS. 8A and 8B, internal regions are shown in FIGS. 8C and 8D and C-terminal regions are shown in FIGS. 8E-8G.

FIGS. 9A-9C present 3 tables showing the percent identity between amino acid sequences found in the TGF-β family. FIG. 9A demonstrates percent identity among pro-proteins (prodomain and growth factor.) Percent identity among growth factor domains is presented in FIG. 9B while percent identity among prodomains is presented in FIG. 9C.

FIG. 13 depicts recombinant histidine-tagged proGDF-8, separated by SDS-PAGE under reducing and non-reducing conditions, as visualized by Coomassie staining.

DETAILED DESCRIPTION

Figure 1:
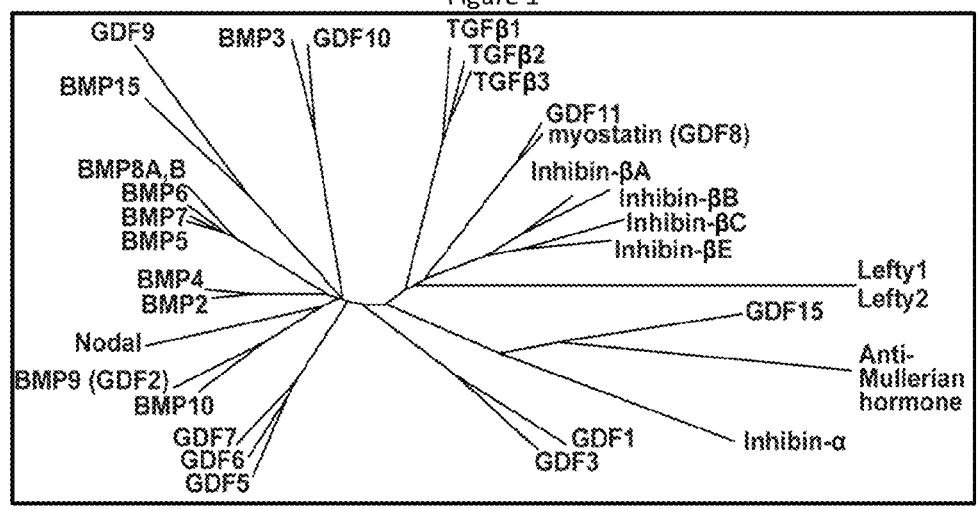
FIG. 1 is a diagram of the TGF-beta superfamily tree, where divergence is proportional to branch length.

Growth factors are cell signaling molecules that stimulate a variety of cellular activities. Due to their broad-reaching influence within biological systems, growth factor signaling is tightly regulated, often through interactions with other biomolecules, the extracellular and/or cellular matrix or within a particular cell environment or niche. These interactions may be direct or indirect.

Growth factors of the transforming growth factor beta (TGF-β) family are involved in a variety of cellular processes. Growth factor binding to type II receptors leads to type I receptor phosphorylation and activation (Denicourt, C. et al., Another twist in the transforming growth factor β-induced cell-cycle arrest chronicle. PNAS. 2003. 100(26):15290-1.) Activated type I receptors may in turn phosphorylate receptor-associated SMADs (R-SMADs) promoting co-SMAD (e.g. SMAD4) dimer/trimer formation and nuclear translocation. SMAD complexes collaborate with cofactors to modulate expression of TGF-β family member target genes.

TGF-β family member signaling cascades are involved in a number of diverse biological pathways including, but not limited to inhibition of cell growth, tissue homeostasis, extracellular matrix (ECM) remodeling, endothelial to mesenchymal transition (EMT) in cell migration and invasion and immune modulation/suppression as well as in mesenchymal to epithelial transition. TGF-β signaling related to growth inhibition and tissue homeostasis may affect epithelial, endothelial, hematopoietic and immune cells through the activation of p21 and p15' to mediate cell cycle arrest and repress myc. In relation to ECM remodeling, TGF-β signaling may increase fibroblast populations and ECM deposition (e.g. collagen). TGF-β signaling related to cell migration and invasion may affect epithelial and/or endothelial cells, inducing stem cell-like phenotypes. This aspect of signaling may play a role in smooth muscle cell proliferation following vascular surgery and/or stenting. In the immune system, TGF-β ligand is necessary for T regulatory cell function and maintenance of immune precursor cell growth and homeostasis. Nearly all immune cells comprise receptors for TGF-β and TGF-β knockout mice die postnataly due in part to inflammatory pathologies. Finally, TGF-β suppresses interferon gamma-induced activation of natural killer cells (Wi, J. et al., 2011. Hepatology. 53(4):1342-51, the contents of which are herein incorporated by reference in their entirety.)

The recent solution of the crystal structure of the latent form of TGF-beta is a first for the entire TGF-beta family and offers deep insights into these complexes (Shi, M. et al., *Latent TGF-β structure and activation*. Nature. 2011 Jun. 15; 474(7351):343-9). Almost all signaling in the TGF-beta family goes through a common pathway whereby a dimeric ligand is recognized by a heterotetrameric receptor complex containing two type I and two type II receptors. Each receptor has a serine-threonine kinase domain. Type II receptors phosphorylate type I receptors, which in turn phosphorylate receptor-regulated Smads that translocate to and accumulate in the nucleus and regulate transcription.

Figure 2:
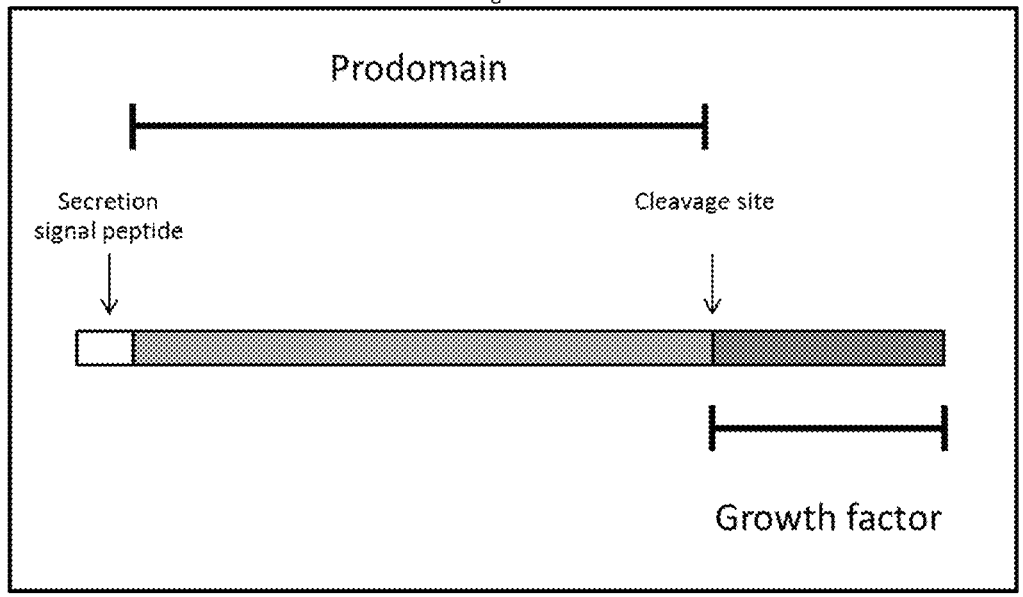
FIG. 2 is a schematic of one embodiment of a linear representation of a translated growth factor monomer. In such embodiments, translated growth factors may comprise secretion signal peptides, prodomains and growth factor domains. In embodiments according to embodiment depicted here, translated growth factors may also comprise a cleavage site between prodomain and growth factor regions.

There are 33 different members of the TGF-beta family in humans (FIG. 1). Members include the bone morphogenetic proteins (BMP), inhibin, activin, growth and differentiation factor (GDF), myostatin, nodal, anti-Mullerian hormone, and lefty proteins. A review of TGF-β family members, related signaling molecules as well as their relationships can be found in Massague., 2000. Nature Reviews Molecular Cell Biology. 1:169-78, the contents of which are herein incorporated by reference in their entirety. In some embodiments, mature growth factors are synthesized along with their prodomains as single polypeptide chains (see FIG. 2). In some embodiments, such polypeptide chains may comprise cleavage sites for separation of prodomains from mature growth factors. In some embodiments, such cleavage sites are furin cleavage sites recognized and cleaved by proprotein convertases.

In general, homology among TGF-β family member growth factor domains is relatively high. Interestingly, prodomain homology is much lower. This lack of homology may be an important factor in altered growth factor regulation among family members. In some cases, prodomains may guide proper folding and/or dimerization of growth factor domains. Prodomains have very recently been recognized, in some cases, to have important functions in directing growth factors (after secretion) to specific locations in the extracellular matrix (ECM) and/or cellular matrix, until other signals are received that cause growth factor release from latency. Release from latency may occur in highly localized environments whereby growth factors may act over short distances (e.g. from about 1 cell diameter to about a few cell diameters, from about 2 cell diameters to about 100 cell diameters and/or from about 10 cell diameters to about 10,000 cell diameters) and cleared once they reach the circulation. Some growth factor-prodomain complexes are secreted as homodimers. In some embodiments, prodomain-growth factor complexes may be secreted as heterodimers.

As used herein, the term "TGF-β-related protein" refers to a TGF-β isoform, a TGF-β family member or a TGF-β family member-related protein. TGF-β family members may include, but are not limited to any of those shown in FIG. 1 and/or listed in Table 1. These include, but are not limited to TGF-β proteins, BMPs, myostatin, GDFs and inhibins. In some embodiments, the present invention provides tools and/or methods for isolating, characterizing and or modulating TGF-β-related proteins. Aspects of the present invention provide tools and/or methods for characterizing and/or modulating cellular activities related to TGF-β-related protein signaling. In other embodiments, tools of the present invention may comprise antigens comprising one or more components of one or more TGF-β-related proteins. Some tools may comprise antibodies directed toward antigens of the present invention. In additional embodiments, tools of the present invention may comprise assays for the detection and/or characterization of TGF-β-related proteins, the detection and/or characterization of antibodies directed toward TGF-β-related proteins and/or the detection and/or characterization of cellular activities and/or their cellular signaling related to TGF-β-related proteins.

Proteins of Interest

TGF-β-related proteins are involved in a number of cellular processes. In embryogenesis, the 33 members of the TGF-β family of proteins are involved in regulating major developmental processes and the details of the formation of many organs. Much of this regulation occurs before birth; however, the family continues to regulate many processes after birth, including, but not limited to immune responses, wound healing, bone growth, endocrine functions and muscle mass. TGF-β-related proteins are listed and described in U.S. Provisional Patent Applications 61/722,919, filed Nov. 6, 2012; 61/722,969, filed Nov. 6, 2012 and 61/823,552, filed May 15, 2013 the contents of each of which are herein incorporated by reference in their entireties.

A list of exemplary TGF-β family pro-proteins, i.e. the protein after removal of the secretion signal sequence, is shown in Table 1. The pro-protein contains, and is the precursor of, the prodomain and the growth factor. Shown in the Table are the names of the originating TGF-β family member and the pro-protein sequence. Also identified in "bold" and "underlined" are proprotein convertase cleavage sites. Upon cleavage, the resulting prodomain retains this site, whereas the mature growth factor begins following the cleavage site. It is noted that Lefty1 and Lefty2 are not cleaved by proprotein convertases just prior to the start of the mature growth factor.

TABLE 1

Pro-proteins of the TGF-beta family

| TGF Member | Prodomain and growth factor Sequence | SEQ ID NO |
|---|---|---|
| TGF-β1 | LSTCKTIDMELVKRKRIEAIRGQILSKLRLASPP SQGEVPPGPLPEAVLALYNSTRDRVAGESAEPEP EPEADYYAKEVTRVLMVETHNEIYDKFKQSTHSI YMFFNTSELREAVPEPVLLSRAELRLLRLKLKVE DQHVELYQKYSNNSWRYLSNRLLAPSDSPEWLSF VTGVVRQWLSRGGEIEGFRLSAHCSCDSRDNTLQ VDINGFTTGRRGDLATIHGMNRPFLLLMATPLER AQHLQSSRHRRALDTNYCFSSTEKNCCVRQLYID FRKDLGWKWIHEPKGYHANFCLGPCPYIWSLDTQ YSKVLALYNQHNPGASAAPCCVPQALEPLPIVYY VGRKPKVEQLSNMIVRSCKCS | 1 |
| TGF-β2 | SLSTCSTLDMDQFMRKRIEAIRGQILSKLKLTSP PEDYPEPEEVPPEVISIYNSTRDLLQEKASRRAA ACERERSDEEYYAKEVYKIDMPPFFPSENAIPPT FYRPYFRIVRFDVSAMEKNASNLVKAEFRVFRLQ NPKARVPEQRIELYQILKSKDLTSPTQRYIDSKV VKTRAEGEWLSFDVTDAVHEWLHHKDRNLGFKIS LHCPCCTFVPSNNYIIPNKSEELEARFAGIDGTS TYTSGDQKTIKSTRKKNSGKTPHLLLMLLPSYRL ESQQTNRRKKRALDAAYCFRNVQDNCCLRPLYID FKRDLGWKWIHEPKGYNANFCAGACPYLWSSDTQ HSRVLSLYNTINPEASASPCCVSQDLEPLTILYY IGKTPKIEQLSNMIVKSCKCS | 2 |
| TGF-β3 | SLSLSTCTTLDFGHIKKKRVEAIRGQILSKLRLT SPPEPTVMTHVPYQVLALYNSTRELLEEMHGERE EGCTQENTESEYYAKEIHKFDMIQGLAEHNELAV CPKGITSKVFRFNVSSVEKNRTNLFRAEFRVLRV PNPSSKRNEQRIELFQILRPDEHIAKQRYIGGKN LPTRGTAEWLSFDVTDTVREWLLRRESNLGLEIS IHCPCHTFQPNGDILENIHEVMEIKFKGVDNEDD HGRGDLGRLKKQKDHHNPHLILMMIPPHRLDNPG QGGQRKKRALDTNYCFRNLEENCCVRPLYIDFRQ DLGWKWVHEPKGYYANFCSGPCPYLRSADTTHST VLGLYNTLNPEASASPCCVPQDLEPLTILYYVGR TPKVEQLSNMVVKSCKCS | 3 |
| GDF-11 | AEGPAAAAAAAAAAAAGVGGERSSRPAPSVAPE PDGCPVCVWRQHSRELRLESIKSQILSKLRLKEA PNISREVVKQLLPKAPPLQQILDLHDFQGDALQP EDFLEEDEYHATTETVISMAQETDPAVQTDGSPL CCHFHFSPKVMFTKVLKAQLWVYLRPVPRPATVY LQILRLKPLTGEGTAGGGGGRRHIRIRSLKIEL HSRSGHWQSIDFKQVLHSWFRQPQSNWGIEINAF DPSGTDLAVTSLGPGAEGLHPFMELRVLENTKRS RRNLGLDCDEHSSESRCCRYPLTVDFEAFGWDWI IAPKRYKANYCSGQCEYMFMQKYPHTHLVQQANP RGSAGPCCTPTKMSPINMLYFNDKQQIIYGKIPG MVVDRCGCS | 4 |
| GDF-8 (myostatin) | NENSEQKENVEKEGLCNACTWRQNTKSSRIEAIK IQILSKLRLETAPNISKDVIRQLLPKAPPLRELI DQYDVQRDDSSDGSLEDDDYHATTETIITMPTES DFLMQVDGKPKCCFFKFSSKIQYNKVVKAQLWIY LRPVETPTTVFVQILRLIKPMKDGTRYTGIRSLK LDMNPGTGIWQSIDVKTVLQNWLKQPESNLGIEI KALDENGHDLAVTFPGPGEDGLNPFLEVKVTDTP KRSRRDFGLDCDEHSTESRCCRYPLTVDFEAFGW DWIIAPKRYKANYCSGECEFVFLQKYPHTHLVHQ ANPRGSAGPCCTPTKMSPINMLYFNGKEQHYGKI PAMVVDRCGCS | 5 |
| Inhibin-beta A | SPTPGSEGHSAAPDCPSCALAALPKDVPNSQPEM VEAVKKHILNMLHLKKRPDVTQPVPKAALLNAIR KLHVGKVGENGYVEIEDDIGRRAEMNELMEQTSE IITFAESGTARKTLHFEISKEGSDLSVVERAEVW LFLKVPKANRTRTKVTIRLFQQQKHPQGSLDTGE EAEEVGLKGERSELLLSEKVVDARKSTWHVFPVS SSIQRLLDQGKSSLDVRIACEQCQESGASLVLLG KKKKKEEEGEGKKKGGGEGGAGADEEKEQSHRPF LMLQARQSEDHPHRRRRRGLECDGKVNICCKKQF | 6 |

TABLE 1-continued

Pro-proteins of the TGF-beta family

| TGF Member | Prodomain and growth factor Sequence | SEQ ID NO |
|---|---|---|
| | FVSFKDIGWNDWIIAPSGYHANYCEGECPSHIAG TSGSSLSFHSTVINHYRMRGHSPFANLKSCCVPT KLRPMSMLYYDDGQNIIKKDIQNMIVEECGCS | |
| Inhibin-beta B | SPTPPPTPAAPPPPPPPGSPGGSQDTCTSCGGFR RPEELGRVDGDFLEAVKRHILSRLQMRGRPNITH AVPKAAMVTALRKLHAGKVREDGRVEIPHLDGHA SPGADGQERVSEIISFAETDGLASSRVRLYFFIS NEGNQNLFVVQASLWLYLKLLPYVLEKGSRRKVR VKVYFQEQGHGDRWNMVEKRVDLKRSGWHTFPLT EAIQALFERGERRLNLDVQCDSCQELAVVPVFVD PGEESHRPFVVVQARLGDSRHRIRKRGLECDGRT NLCCRQQFFIDFRLIGWNDWIIAPTGYYGNYCEG SCPAYLAGVPGSASSFHTAVVNQYRMRGLNPGTV NSCCIPTKLSTMSMLYFDDEYNIVKRDVPNMIVE ECGCA | 7 |
| Inhibin-beta C | TPRAGGQCPACGGPTLELESQRELLLDLAKRSIL DKLHLTQRPTLNRPVSRAALRTALQHLHGVPQGA LLEDNREQECEIISFAETGLSTINQTRLDFHFSS DRTAGDREVQQASLMFFVQLPSNTTWTLKVRVLV LGPHNTNLTLATQYLLEVDASGWHQLPLGPEAQA ACSQGHLTLELVLEGQVAQSSVILGGAAHRPFVA ARVRVGGKHQIHRRGIDCQGGSRMCCRQEFFVDF REIGWHDWIIQPEGYAMNFCIGQCPLHIAGMPGI AASFHTAVLNLLKANTAAGTTGGGSCCVPTARRP LSLLYYDRDSNIVKTDIPDMVVEACGCS | 8 |
| Inhibin-beta E | QGTGSVCPSCGGSKLAPQAERALVLELAKQQILD GLHLTSRPRITHPPPQAALTRALRRLQPGSVAPG NGEEVISFATVTDSTSAYSSLLTFHLSTPRSHHL YHARLWLHVLPTLPGTLCLRIFRWGPRRRRQGSR TLLAEHHITNLGWHTLTLPSSGLRGEKSGVLKLQ LDCRPLEGNSTVTGQPRRLLDTAGHQQPFLELKI RANEPGAGRARRRTPTCEPATPLCCRRDHYVDFQ ELGWRDWILQPEGYQLNYCSGQCPRHLAGSPGIA ASFHSAVFSLLKANNPWPASTSCCVPTARRPLSL LYLDHNGNVVKTDVPDMVVEACGCS | 9 |
| Lefty1 | LTGEQLLGSLLRQLQLKEVPTLDRADMEELVIPT HVRAQYVALLQRSHGDRSRGKRFSQSFREVAGRF LALEASTHLLVFGMEQRLPPNSELVQAVLRLFQE PVPKAALHRHGRLSPRSARARVTVEWLRVDDGS NRTSLIDSRLVSVHESGWKAFDVTEAVNFWQQLS RPRQPLLLQVSVQREHLGPLASGAHKLVRFASQG APAGLGEPQLELHTLDLGDYGAQGDCDPEAPMTE GTRCCRQEMYIDLQGMKWAENWVLEPPGFLAYEC VGTCRQPPEALAFKWPFLGPRQCIASETDSLPMI VSIKEGGRTRPQVVSLPNMRVQKCSCASDGALVP RRLQP | 10 |
| Lefty2 | LTEEQLLGSLLRQLQLSEVPVLDRADMEKLVIPA HVRAQYVVLLRRSHGDRSRGKRFSQSFREVAGRF LASEASTHLLVFGMEQRLPPNSELVQAVLRLFQE PVPKAALHRHGRLSPRSAQARVTVEWLRVDDGS NRTSLIDSRLVSVHESGWKAFDVTEAVNFWQQLS RPRQPLLLQVSVQREHLGPLASGAHKLVRFASQG APAGLGEPQLELHTLDLRDYGAQGDCDPEAPMTE GTRCCRQEMYIDLQGMKWAKNWVLEPPGFLAYEC VGTCQQPPEALAFNWPFLGPRQCIASETASLPMI VSIKEGGRTRPQVVSLPNMRVQKCSCASDGALVP RRLQP | 11 |
| GDF-15 | LSLAEASRASFPGPSELHSEDSRFRELRKRYEDL LTRLRANQSWEDSNTDLVPAPAVRILTPEVRLGS GGHLHLRISRAALPEGLPEASRLHRALFRLSPTA SRSWDVTRPLRRQLSLARPQAPALHLRLSPPPSQ SDQLLAESSSARPQLELHLRPQAARGRRRARARN GDHCPLGPGRCCRLHTVRASLEDLGWADWVLSPR EVQVTMCIGACPSQFRAANMHAQIKTSLHRLKPD TVPAPCCVPASYNPMVLIQKTDTGVSLQTYDDLL AKDCHCI | 12 |

TABLE 1-continued

Pro-proteins of the TGF-beta family

| TGF Member | Prodomain and growth factor Sequence | SEQ ID NO |
|---|---|---|
| Anti-Mullerian hormone | LLGTEALRAEEPAVGTSGLIFREDLDWPPGIPQE PLCLVALGGDSNGSSSPLRVVGALSAYEQAFLGA VQRARWGPRDLATFGVCNTGDRQAALPSLRRLGA WLRDPGGQRLVVLHLEEVTWEPTPSLRFQEPPPG GAGPPELALLVLYPGPGPEVTVTRAGLPGAQSLC PSRDTRYLVLAVDRPAGAWRGSGLALTLQPRGED SRLSTARLQALLFGDDHRCFTRMTPALLLLPRSE PAPLPAHGQLDTVPFPPPRPSAELEESPPSADPF LETLTRLVRALRVPPARASAPRLALDPDALAGFP QGLVNLSDPAALERLLDGEEPLLLLLRPTAATTG DPAPLHDPTSAPWATALARRVAAELQAAAAELRS LPGLPPATAPLLARLLALCPGGPGGLGDPLRALL LLKALQGLRVEWRGRDPRGPGRAQRSAGATAADG PCALRELSVDLRAERSVLIPETYQANNCQGVCGW PQSDRNPRYGNHVVLLLKMQVRGAALARPPCCVP TAYAGKLLISLSEERISAHHVPNMVATECGCR | 13 |
| Inhibin-alpha | CQGLELARELVLAKVRALFLDALGPPAVTREGGD PGVRRLPRRHALGGFTHRGSEPEEEEDVSQAILF PATDASCEDKSAARGLAQEAEEGLFRYMFRPSQH TRSRQVTSAQLWFHTGLDRQGTAASNSSEPLLGL LALSPGGPVAVPMSLGHAPPHWAVLHLATSALSL LTHPVLVLLLRCPLCTCSARPEATPFLVAHTRTR PPSGGERARRSTPLMSWPWSPSALRLLQRPPEEP AAHANCHRVALNISFQELGWERWIVYPPSFIFHY CHGGCGLHIPPNLSLPVPGAPPTPAQPYSLLPGA QPCCAALPGTMRPLHVRTTSDGGYSFKYETVPNL LTQHCACI | 14 |
| GDF-1 | PVPPGPAAALLQALGLRDEPQGAPRLRPVPPVMW RLFRRRDPQETRSGSRRTSPGVTLQPCHVEELGV AGNIVRHIPDRGAPTRASEPASAAGHCPEWTVVF DLSAVEPAERPSRARLELRFAAAAAAAPEGGWEL SVAQAGQGAGADPGPVLLRQLVPALGPPVRAELL GAAWARNASWPRSLRLALALRPRAPAACARLAEA SLLLVTLDPRLCHPLARPRRDAEPVLGGGPGGAC RARRLYVSFREVGWHRWVIAPRGFLANYCQGQCA LPVALSGSGGPPALNHAVLRALMHAAAPGAADLP CCVPARLSPISVLFFDDSNDNVVLRQYEDMVVDEC GCR | 15 |
| GDF-3 | QEYVFLQFLGLDKAPSPQKFQPVPYILKKIFQDR EAAATTGVSRDLCYVKELGVRGNVLRFLPDQGFF LYPKKISQASSCLQKLLYFNLSAIKEREQLTLAQ LGLDLGPNSYYNLGPELELALFLVQEPHVWGQTT PKPGKMFVLRSVPWPQGAVHFNLLDVAKDWNDNP RKNFGLFLEILVKEDRDSGVNFQPEDTCARLRCS LHASLLVVTLNPDQCHPSRKRRAAIPVPKLSCKN LCHRHQLFINFRDLGWHKWIIAPKGFMANYCHGE CPFSLTISLNSSNYAFMQALMHAVDPEIPQAVCI PTKLSPISMLYQDNNDNVILRHYEDMVVDECGCG | 16 |
| GDF-5 | APDLGQRPQGTRPGLAKAEAKERPPLARNVFRPG GHSYGGGATNANARAKGGTGQTGGLTQPKKDEPK KLPPRPGGPEPKPGHPPQTRQATARTVTPKGQLP GGKAPPKAGSVPSSFLLKKAREPGPPREPKEPFR PPPITPHEYMLSLYRTLSDADRKGGNSSVKLEAG LANTITSFIDKGQDDRGPVVRKQRYVFDISALEK DGLLGAELRILRKKPSDTAKPAAPGGGRAAQLKL SSCPSGRQPASLLDVRSVPGLDGSGWEVFDIWKL FRNFKNSAQLCLELEAWERGRAVDLRGLGFDRAA RQVHEKALFLVFGRTKKRDLFFNEIKARSGQDDK TVYEYLFSQRRKRRAPLATRQGKRPSKNLKARCS RKALHVNFKDMGWDDWIIAPLEYEAFHCEGLCEF PLRSHLEPTNHAVIQTLMNSMDPESTPPTCCVPT RLSPISILFIDSANNVVYKQYEDMVVESCGCR | 17 |
| GDF-6 | FQQASISSSSSAELGSTKGMRSRKEGKMQRAPR DSDAGREGQEPQPRPQDEPRAQQPRAQEPPGRGP RVVPHEYMLSIYRTYSIAEKLGINASFFQSSKSA NTITSFVDRGLDDLSHTPLRRQKYLFDVSMLSDK EELVGAELRLFRQAPSAPWGPPAGPLHVQLFPCL SPLLLDARTLDPQGAPPAGWEVFDVWQGLRHQPW | 18 |

TABLE 1-continued

Pro-proteins of the TGF-beta family

| TGF Member | Prodomain and growth factor Sequence | SEQ ID NO |
|---|---|---|
| | KQLCLELRAAWGELDAGEAEARARGPQQPPPPDL RSLGFGRRVRPPQERALVVFTRSQRKNLFAEMR EQLGSAEAAGPGAGAEGSWPPPSGAPDARPWLPS PGRRRRRRTAFASRHGKRHGKKSRLRCSKKPLHVN FKELGWDDWIIAPLEYEAYHCEGVCDFPLRSHLE PTNHAIIQTLMNSMDPGSTPPSCCVPTKLTPISI LYIDAGNNVVYKQYEDMVVESCGCR | |
| GDF-7 | RDGLEAAAVLRAAGAPVRSPGGGGGGGGGRTL AQAAGAAAVPAAAVPRARAARRAAGSGFRNGSVV PHHFMMSLYRSLAGRAPAGAAAVSASGHGRADTI TGFTDQATQDESAAETGQSFLFDVSSLNDADEVV GAELRVLRRGSPESGPGSWTSPPLLLLSTCPGAA RAPRLLYSRAAEPLVGQRWEAFDVADAMRRHRRE PRPPRAFCLLLRAVAGPVPSPLALRRLGFGWPGG GGSAAEERAVLVVSSRTQRKESLFREIRAQARAL GAALASEPLPDPGTGTASPRAVIGGRRRRRTALA GTRTAQGSGGGAGRGHRRGRSRCSRKPLHVDFK ELGWDDWIIAPLDYEAYHCEGLCDFPLRSHLEPT NHAIIQTLLNSMAPDAAPASCCVPARLSPISILY IDAANNVVYKQYEDMVVEACGCR | 19 |
| BMP-10 | SPIMNLEQSPLEEDMSLFGDVFSEQDGVDFNTLL QSMKDEFLKTLNLSDIPTQDSAKVDPPEYMLELY NKFATDRTSMPSANIIRSFKNEDLFSQPVSFNGL RKYPLLFNVSIPHHEEVIMAELRLYTLVQRDRMI YDGVDRKITIFEVLESKGDNEGERNMLVLVSGEI YGTNSEWETFDVTDAIRRWQKSGSSTHQLEVHIE SKHDEAEDASSGRLEIDTSAQNKHNPLLIVFSDD QSSDKERKEELNEMISHEQLPELDNLGLDSFSSG PGEEALLQMRSNIIYDSTARIRRNAKGNYCKRTP LYIDFKEIGWDSWIIAPPGYEAYECRGVCNYPLA EHLTPTKHAIIQALVHLKNSQKASKACCVPTKLE PISILYLDKGVVTYKFKYEGMAVSECGCR | 20 |
| BMP-9 (GDF-2) | KPLQSWGRGSAGGNAHSPLGVPGGGLPEHTFNLK MFLENVKVDFLRSLNLSGVPSQDKTRVEPPQYMI DLYNRYTSDKSTTPASNIVRSFSMEDAISITATE DFPPQKHILLFNISIPRHEQITRAELRLYVSCQN HVDPSHDLKGSVVIYDVLDGTDAWDSATETKTFL VSQDIQDEGWETLEVSSAVKRWVRSDSTKSKNKL EVTVESHRKGCDTLDISVPPGSRNLPFFVVFSND HSSGTKETRLELREMISHEQESVLKKLSKDGSTE AGESSHEEDTDGHVAAGSTLARRRKRSAGAGSHCQ KTSLRVNFEDIGWDSWIIAPKEYEAYECKGGCFF PLADDVTPTKHAIVQTLVHLKFPTKVGKACCVPT KLSPISVLYKDDMGVPTLKYHYEGMSVAECGCR | 21 |
| Nodal | TVATALLRTRGQPSSPSPLAYMLSLYRDPLPRAD IIRSLQAEDVAVDGQNWTFAFDFSFLSQQEDLAW AELRLQLSSPVDLPTEGSLAIEIFHQPKPDTEQA SDSCLERFQMDLFTVTLSQVTFSLGSMVLEVTRP LSKWLKRPGALEKQMSRVAGECWPRPPTPPATNV LLMLYSNLSQEQRQLGGSTLLWEAESSWRAQEGQ LSWEWGKRHRRHHLPDRSQLCRKVKFQVDFNLIG WGSWIIYPKQYNAYRCEGECPNPVGEEFHPTNHA YIQSLLKRYQPHRVPSTCCAPVKTKPLSMLYVDN GRVLLDHHKDMIVEECGCL | 22 |
| BMP-2 | LVPELGRRKFAAASSGRPSSQPSDEVLSEFELRL LSMFGLKQRPTPSRDAVVPPYMLDLYRRHSGQPG SPAPDHRLERAASRANTVRSFHHEESLEELPETS GKTTRRFFFNLSSIPTEEFITSAELQVFREQMQD ALGNNSSFHHRINIYEIIKPATANSKFPVTRLLD TRLVNQNASRWESFDVTPAVMRWTAQGHANHGFV VEVAHLEEKQGVSKRHVRISRSLHDEHSWSQIR PLLVTFGHDGKGHPLHKREKRQAKHKQRKRLKSS CKRHPLYVDFSDVGWNDWIVAPPGYHAFYCHGEC PFPLADHLNSTNHAIVQTLVNSVNSKIPKACCVP TELSAISMLYLDENEKVVLKNYQDMVVEGCGCR | 23 |
| BMP-4 | GASHASLIPETGKKKVAEIQGHAGGRRSGQSHEL LRDFEATLLQMFGLRRRPQPSKSAVIPDYMRDLY RLQSGEEEEEQIHSTGLEYPERPASRANTVRSFH HEEHLENIPGTSENSAFRFLFNLSSIPENEVISS AELRLFREQVDQGPDWERGFHRINIYEVMKPPAE VVPGHLITRLLDTRLVHHNVTRWETFDVSPAVLR WTREKQPNYGLAIEVTHLHQTRTHQGQHVRISRS LPQGSGNWAQLRPLLVTFGHDGRGHALTRRRAK RSPKHHSQRARKKNKNCRRHSLYVDFSDVGWNDW IVAPPGYQAFYCHGDCPFPLADHLNSTNHAIVQT LVNSVNSSIPKACCVPTELSAISMLYLDEYDKVV LKNYQEMVVEGCGCR | 24 |
| BMP-5 | DNHVHSSFIYRRLRNHERREIQREILSILGLPHR PRPFSPGKQASSAPLFMLDLYNAMTNEENPEESE YSVRASLAEETRGARKGYPASPNGYPRRIQLSRT TPLTTQSPPLASLHDTNFLNDADMVMSFVNLVER DKDFSHQRRHLYKEFRFDLTQIPHGEAVTAAEFRI YKDRSNNRFENETIKISIYQIIKEYTNRDADLFL LDTRKAQALDVGWLVFDITVTSNHWVINPQNNLG LQLCAETGDGRSINVKSAGLVGRQGPQSKQPFMV AFFKASEVLLRSVRAANKRKNQNRNKSSSHQDSS RMSSVGDYNTSEQKQACKKHELYVSFRDLGWQDW IIAPEGYAAFYCDGECSFPLNAHMNATNHAIVQT LVHLMFPDHVPKCCCAPTKLNAISVLYFDDSSNV ILKKYRNMVVRSCGCH | 25 |
| BMP-6 | CCGPPPLRPPPLPAAAAAAAGGQLLGDGGSPGRTE QPPPSPQSSSGFLYRRLKTQEKREMQKEILSVLG LPHRPRPLHGLQQPQPPALRQQEEQQQQQLPRG EPPPGRLKSAPLFMLDLYNALSADNDEDGASEGE RQQSWPHEAASSSQRRQPPPGAAHPLNRKSLLAP GSGSGGASPLTSAQDSAFLNDADMVMSFVNLVEY DKEFSPRQRHHKEFKFNLSQIPEGEVVTAAEFRI YKDCVMGSFKNQTFLISIYQVLQEHQHRDSDLFL LDTRVVWASEEGWLEFDITATSNLWVVTPQHNMG LQLSVVTRDGVHVHPRAAGLVGRDGPYDKQPFMV AFFKVSEVHVRTTRSASSRRRQQSRNRSTQSQDV ARVSSASDYNSSELKTACRKHELYVSFQDLGWQD WIIAPKGYAANYCDGECSFPLNAHMNATNHAIVQ TLVHLMNPEYVPKCCCAPTKLNAISVLYFDDNSN VILKKYRNMVVRACGCH | 26 |
| BMP-7 | DFSLDNEVHSSFIHRRLRSQERREMQREILSILG LPHRPRPHLQGKHNSAPMFMLDLYNAMAVEEGGG PGGQGFSYPYKAVFSTQGPPLASLQDSHFLTDAD MVMSFVNLVEHDKEFFHPRYHHREFRFDLSKIPE GEAVTAAEFRIYKDYIRERFDNETFRISVYQVLQ EHLGRESDLFLLDSRTLWASEEGWLVFDITATSN HWVVNPRHNLGLQLSVETLDGQSINPKLAGLIGR HGPQNKQPFMVAFFKATEVHFRSIRSTGSKQRSQ NRSKTPKNQEALRMANVAENSSSDQRQACKKHEL YVSFRDLGWQDWIIAPEGYAAYYCEGECAFPLNS YMNATNHAIVQTLVHFINPETVPKCCAPTQLNA ISVLYFDDSSNVILKKYRNMVVRACGCH | 27 |
| BMP-8A | GGGPGLRPPPGCPQRRLGARERRDVQREILAVLG LPGRPRPRAPPAASRLPASAPLFMLDLYHAMAGD DDEDGAPAEQRLGRADLVMSFVNMVERDRALGHQ EPHWKEFRFDLTQIPAGEAVTAAEFRIYKVPSIH LLNRTLHVSMFQVVQEQSNRESDLFFLDLQTLRA GDEGWLVLDVTAASDCWLLKRHKDLGLRLYVETE DGHSVDPGLAGLLGQRAPRSQQPFVVTFFRASPS PIRRTPRAVRPLRRRQPKKSNELPQANRLPGIFDD VRGSHGRQVCRRHELYVSFQDLGWLDWVIAPGYS AYYCEGECSFPLDSCMNATNHAILQSLVHLMKPN AVPKACCAPTKLSATSVLYYDSSNNVILRKHRNM VVKACGCH | 28 |
| BMP-8B | GGGPGLRPPPGCPQRRLGARERRDVQREILAVLG LPGRPRPRAPPAASRLPASAPLFMLDLYHAMAGD DDEDGAPAEQRLGRADLVMSFVNMVERDRALGHQ EPHWKEFRFDLTQIPAGEAVTAAEFRIYKVPSIH LLNRTLHVSMFQVVQEQSNRESDLFFLDLQTLRA GDEGWLVLDVTAASDCWLLKRHKDLGLRLYVETE DGHSVDPGLAGLLGQRAPRSQQPFVVTFFRASPS PIRRTPRAVRPLRRRQPKKSNELPQANRLPGIFDD | 29 |

TABLE 1-continued

Pro-proteins of the TGF-beta family

| TGF Member | Prodomain and growth factor Sequence | SEQ ID NO |
|---|---|---|
| | VHGSHGRQVCRRHELYVSFQDLGWLDWVIAPQGY SAYYCEGECSFPLDSCMNATNHAILQSLVHLMMP DAVPKACCAPTKLSATSVLYYDSSNNVILRKHRN MVVKACGCH | |
| BMP-15 | MEHRAQMAEGGQSSIALLAEAPTLPLIEELLEES PGEQPRKPRLLGHSLRYMLELYRRSADSHGHPRE NRTIGATMVRLVKPLTSVARPHRGTWHIQILGFP LRPNRGLYQLVRATVVYRHHLQLTRFNLSCHVEP WVQKNPTNHFPSSEGDSSKPSLMSNAWKEMDITQ LVQQRFWNNKGHRILRLRFMCQQQKDSGGLELWH GTSSLDIAFLLLYFNDTHKSIRKAKFLPRGMEEF MERESLLRRTRQADGISAEVTASSSKHSGPENNQ CSLHPFQISFRQLGWDHWIIAPPFYTPNYCKGTC LRVLRDGLNSPNHAIIQNLINQLVDQSVPRPSCV PYKYVPISVLMIEANGSILYKEYEGMIAESCTCR | 30 |
| GDF-9 | SQASGGEAQIAASAELESGAMPWSLLQHIDERDR AGLLPALFKVLSVGRGGSPRLQPDSRALHYMKKL YKTYATKEGIPKSNRSHLYNTVRLFTPCTRHKQA PGDQVTGILPSVELLFNLDRITTVEHLLKSVLLY NINNSVSFSSAVKCVCNLMIKEPKSSSRTLGRAP YSFTFNSQPEFGKKHKWIQIDVTSLLQPLVASNK RSIHMSINFTCMKDQLEHPSAQNGLFNMTLVSPS LILYLNDTSAQAYHSWYSLHYKRRPSQGPDQERS LSAYPVGEEAAEDGRSSHHRHRRGQETVSSELKK PLGPASFNLSEYFRQFLLPQNECELHDFRLSFSQ LKWDNWIVAPHRYNPRYCKGDCPRAVGHRYGSPV HTMVQNIIYEKLDSSVPRPSCVPAKYSPLSVLTI EPDGSIAYKEYEDMIATKCTCR | 31 |
| BMP-3 | ERPKPPFPELRKAVPGDRTAGGGPDSELQPQDKV SEHMLRLYDRYSTVQAARTPGSLEGGSQPWRPRL LREGNTVRSFRAAAAETLERKGLYIFNLTSLTKS ENILSATLYFCIGELGNISLSCPVSGGCSHHAQR KHIQIDLSAWTLKFSRNQSQLLGHLSVDMAKSHR DIMSWLSKDITQLLRKAKENEEFLIGFNITSKGR QLPKRRLPFPEPYILVYANDDAAISEPESVVSSLQ GHRNFPTGTVPKWDSHIRAALSIERRKKRSTGVL LPLQNNELPGAEYQYKKDEVWEERKPYKTLQAQA PEKSKNKKKQRKGPHRKSQTLQFDEQTLKKARRK QWIEPRNCARRYLKVDFADIGWSEWIISPKSFDA YYCSGACQFPMPKSLKPSNHATIQSIVRAVGVVP GIPEPCCVPEKMSSLSILFFDENKNVVLKVYPNM TVESCACR | 32 |
| GDF-10 | SHRAPAWSALPAAADGLQGDRDLQRHPGDAAATL GPSAQDMVAVHMHRLYEKYSRQGARPGGGNTVRS FRARLEVVDQKAVYFFNLTSMQDSEMILTATFHF YSEPPRWPRALEVLCKPRAKNASGRPLPLGPPTR QHLLFRSLSQNTATQGLLRGAMALAPPPRGLWQA KDISPIVKAARRDGELLLSAQLDSEERDPGVPRP SPYAPYILVYANDLAISEPNSVAVTLQRYDPFPA GDPEPRAAPNNSADPRVRRAAQATGPLQDNELPG LDERPPRAHAQHFHKHQLWPSPFRALKPRPGRKD RRKKGQEVFMAASQVLDFDEKTMQKARRKQWDEP RVCSRRYLKVDFADIGWNEWIISPKSFDAYYCAG ACEFPMPKIVRPSNHATIQSIVRAVGIIPGIPEP CCVPDKMNSLGVLFLDENRNVVLKVYPNMSVDTC ACR | 33 |
| GDNF | FPLPAGKRPPEAPAEDRSLGRRRAPFALSSDSNM PEDYPDQFDDVMDFIQATIKRLKRSPDKQMAVLP RRERNRQAAAANPENSRGKGRRGQRGKNRGCVLT AIHLNVTDLGLGYETKEELIFRYCSGSCDAAETT YDKILKNLSRNRRLVSDKVGQACCRPIAFDDDLS FLDDNLVYHILRKHSAKRCGCI | 34 |
| NRTN | IWMCREGLLLSHRLGPALVPLHRLPRTLDARIAR LAQYRALLQGAPDAMELRELTPWAGRPPGPRRRA GPRRRRARARLGARPCGLRELEVRVSELGLGYAS DETVLFRYCAGACEAAARVYDLGLRRLRQRRRLR RERVRAQPCCRPTAYEDEVSFLDAHSRYHTVHEL SARECACV | 35 |

TABLE 1-continued

Pro-proteins of the TGF-beta family

| TGF Member | Prodomain and growth factor Sequence | SEQ ID NO |
|---|---|---|
| PSPN | WGPDARGVPVADGEFSSEQVAKAGGTWLGTHRPL ARLRRALSGPCQLWSLTLSVAELGLGYASEEKVI FRYCAGSCPRGARTQHGLALARLQGQGRAHGGPC CRPTRYTDVAFLDDRHRWQRLPQLSAAACGCGG | 36 |
| ARTN | SLGSAPRSPAPREGPPPVLASPAGHLPGGRTARW CSGRARRPPPQPSRPAPPPPAPPSALPRGGRAAR AGGPGSRARAAGARGCRLRSQLVPVRALGLGHRS DELVRFRFCSGSCRRARSPHDLSLASLLGAGALR PPPGSRPVSQPCCRPTRYEAVSFMDVNSTWRTVD RLSATACGCLG | 37 |

It is noted that some prodomains may be cleaved by pro-protein convertase enzymes. As used herein, the term "pro-protein convertase" refers to an enzyme that cleaves a pro-domain from a translated protein to facilitate protein maturation. Some proprotein convertases of the present invention include the subtilisin-like proprotein convertase (SPC) family member enzymes. The SPC family comprises calcium-dependent serine endoproteases that include, but are not limited to furin/PACE, PC1/3, PC2, PC4, PC5/6, PACE4 and PC7 (Fuller et al., 2009. Invest Ophthalmol Vis Sci. 50(12):5759-68, the contents of which are herein incorporated by reference in their entirety.) GDF-11 may in, in some cases, be cleaved by PC5/6. In some cases, proprotein convertases may cleave proproteins at additional sites, other than those indicated in Table 1. In some embodiments, pro-proteins may be cleaved at a first cleavage site (the first site being the site closest to the N-terminus). In other embodiments, pro-proteins may be cleaved at a cleavage site other than a first cleavage site. In some cases, proprotein convertase cleavage may occur intracellularly. In some cases, proprotein convertase cleavage may occur extracellularly.

Many TGF-β family member proteins are synthesized in conjunction with prodomains. Some prodomains may remain associated with growth factors after cleavage. Such associations may form latent growth factor-prodomain complexes (GPCs) that modulate the availability of growth factors for cell signaling. Growth factors may be released from latency in GPCs through associations with one or more extracellular proteins. In some cases, growth factor release may rely on force applied to GPCs through extracellular protein interactions. Such forces may pull from C-terminal and/or N-terminal regions of GPCs resulting in the release of associated growth factors.

In some TGF-β family members, the prodomain portion of the GPC is responsible for growth factor retention and blocking the interaction of retained growth factors with their receptors. Prodomain portions of GPCs that function in this regard are referred to as latency associated peptides (LAPs). TGF-β1, 2 and 3 are know to comprise LAPs. Some prodomains may comprise LAP-like domains. As used herein, the term "LAP-like domain" refers to prodomain portions of GPCs and/or free prodomains that may be structurally similar or synthesized in a similar manner to LAPs, but that may not function to prevent growth factor/receptor interactions. GDF-8 and GDF-11 prodomains comprise LAP-like domains.

Figure 3:
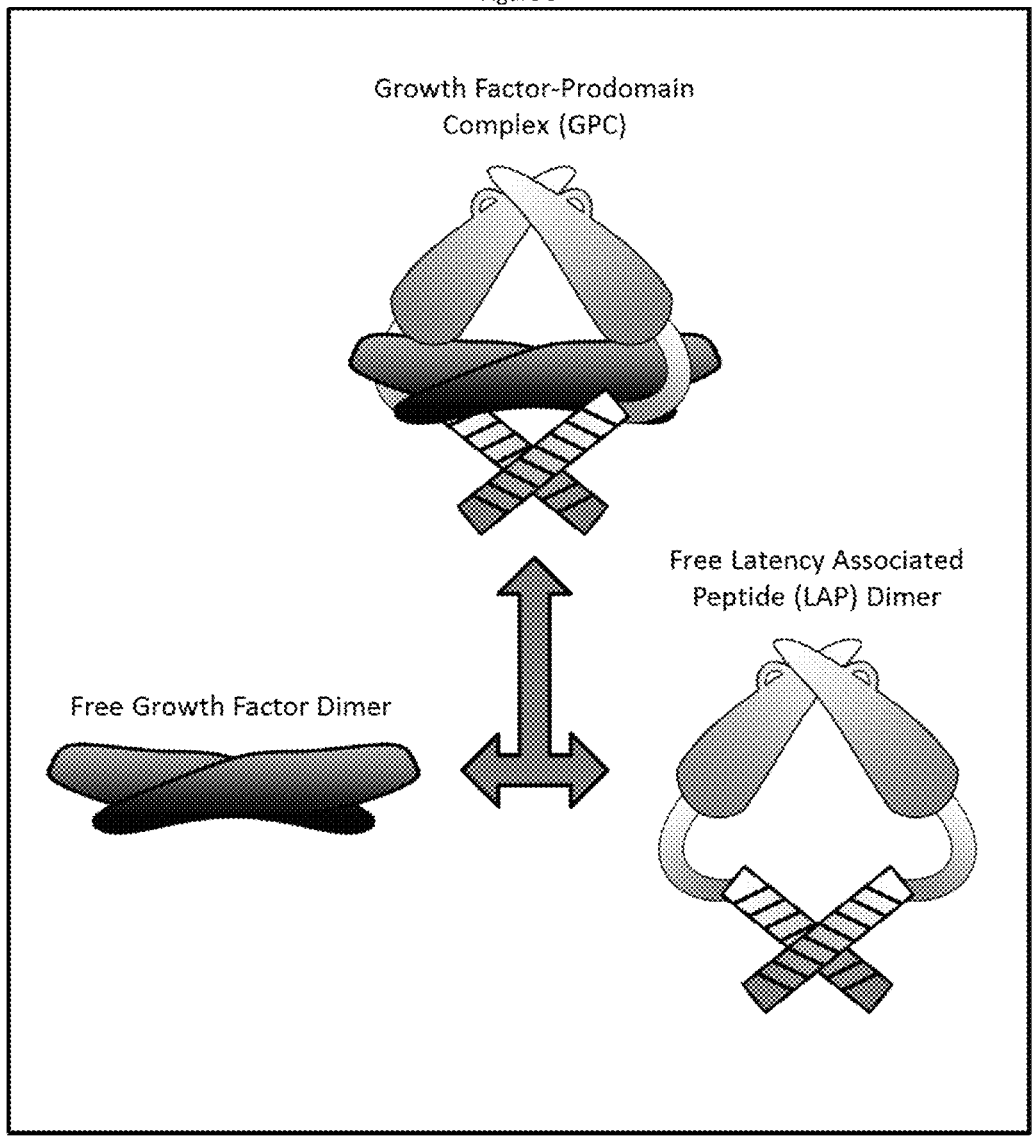
FIG. 3 is a schematic of one embodiment of a growth factor-prodomain complex (GPC) as well as an embodiment of a free growth factor dimer and a free latency associated peptide (LAP) dimer. The arrow indicates the ability of proteins according to this embodiment to alter between free and complexed forms.

Depending on a variety of factors, growth factors may be free or associated with one or more LAP or LAP-like domains. FIG. 3 is a schematic depicting an embodiment wherein a growth factor dimer may associate with a LAP dimer. In some embodiments, GPCs comprise protein modules necessary for different aspects of growth factor signaling, secretion, latency and/or release from latent GPCs. As used herein, the term "protein module" refers to any component, region and/or feature of a protein. Protein modules may vary in length, comprising one or more amino acids. Protein modules may be from about 2 amino acid residues in length to about 50 amino acid residues in length, from about 5 amino acid residues in length to about 75 amino acid residues in length, from about 10 amino acid residues in length to about 100 amino acid residues in length, from about 25 amino acid residues in length to about 150 amino acid residues in length, from about 125 amino acid residues in length to about 250 amino acid residues in length, from about 175 amino acid residues in length to about 400 amino acid residues in length, from about 200 amino acid residues in length to about 500 amino acid residues in length and/or at least 500 amino acid residues in length.

In some embodiments, protein modules comprise one or more regions with known functional features (e.g. protein binding domain, nucleic acid binding domain, hydrophobic pocket, etc.) Protein modules may comprise functional protein domains necessary for different aspects of growth factor signaling, secretion, latency and/or release from latent conformations.

Figure 4:
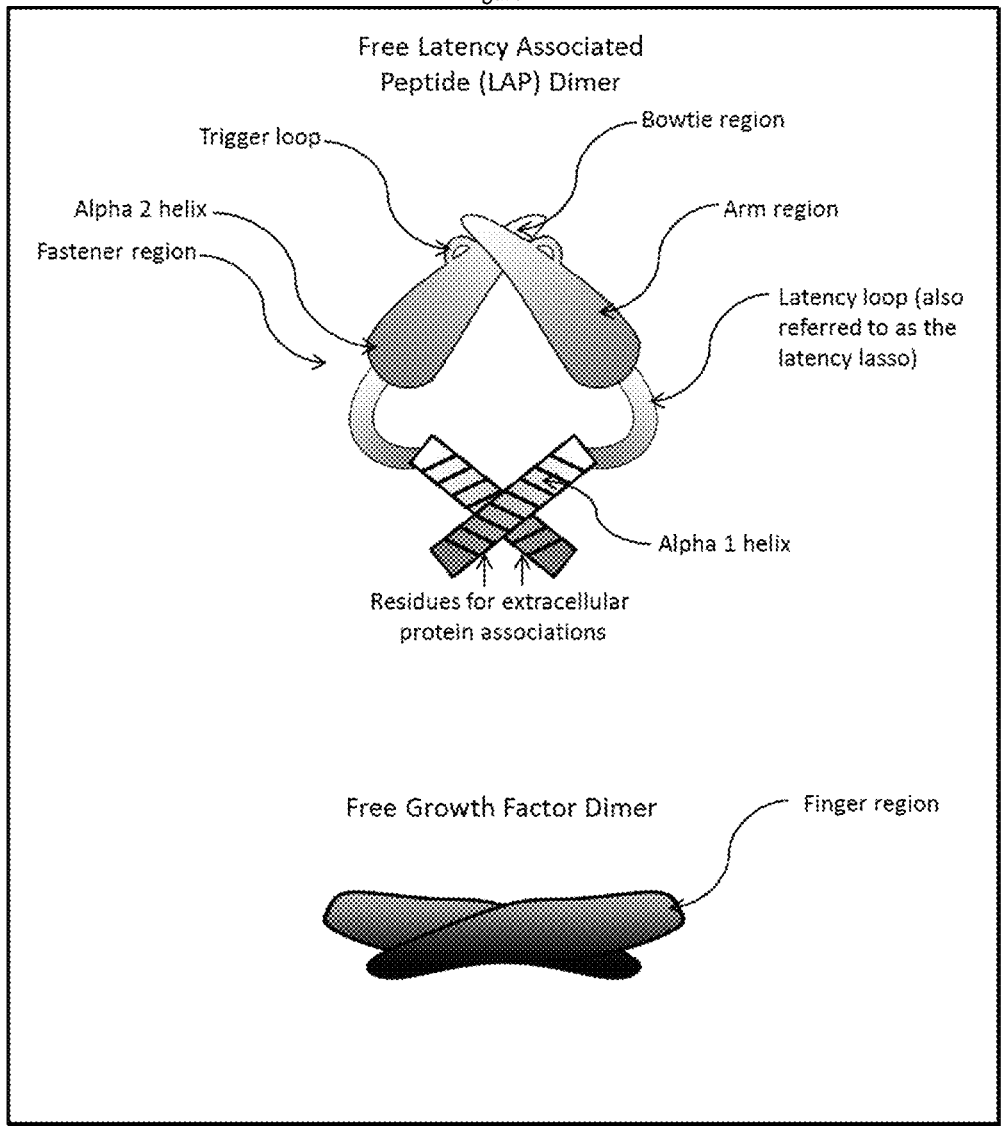
FIG. 4 is a schematic of one embodiment of a free LAP dimer and a free growth factor dimer with labeled features and/or protein modules.

In some embodiments, protein modules may be derived from TGF-β-related proteins. Such protein modules may include, but are not limited to latency-associated peptides (LAPs), LAP-like domains, growth factor domains, fastener regions, proprotein convertase cleavage sites (e.g. furin cleavage sites), B/TP cleavage sites, arm regions, finger regions, residues (such as cysteine residues for example) for extracellular protein [e.g. latent TGF-β binding protein (LTBP), fibrillin and/or glycoprotein A repetitions predominant (GARP) protein] associations, latency loops (also referred to herein as latency lassos,) alpha 1 helical regions, alpha 2 helical regions, RGD sequences and bowtie regions. FIG. 4 is a schematic diagram of an embodiment depicting LAP and growth factor dimers comprising protein modules.

In some embodiments, protein modules may be derived from one or more TGF-β isoform (e.g. TGF-β1, TGF-β2 and/or TGF-β3). Such protein modules may comprise the protein modules and/or amino acid sequences listed in Table 2. Some protein modules of the present invention may comprise amino acid sequences similar to those in Table 2, but comprise additional or fewer amino acids than those listed. Such amino acid sequences may comprise about 1 more or fewer amino acids, about 2 more or fewer amino acids, about 3 more or fewer amino acids, about 4 more or fewer amino acids, about 5 more or fewer amino acids, about 6 more or fewer amino acids, about 7 more or fewer amino acids, about 8 more or fewer amino acids, about 9 more or fewer amino acids, about 10 more or fewer amino acids or greater than 10 more or fewer amino acids on N-terminal and/or C-terminal ends.

TABLE 2

| TGF-β Family Member | Protein Module | Prodomain and growth factor Sequence | SEQ ID NO |
|---|---|---|---|
| TGF-β1 | latency associated peptide | LSTCKTIDMELVKRKRIEAIRGQILS KLRLASPPSQGEVPPGPLPEAVLALY NSTRDRVAGESAEPEPEPEADYYAKE VTRVLMVETHNEIYDKFKQSTHSIYM FFNTSELREAVPEPVLLSRAELRLLR LKLKVEQHVELYQKYSNNSWRYLSNR LLAPSDSPEWLSFDVTGVVRQWLSRG GEIEGFRLSAHCSCDSRDNTLQVDIN GFTTGRRGDLATIHGMNRPFLLLMAT PLERAQHLQSSRHRR | 38 |
| TGF-β2 | latency associated peptide | SLSTCSTLDMDQFMRKRIEAIRGQIL SKLKLTSPPEDYPEPEEVPPEVISIY NSTRDLLQEKASRRAAACERERSDEE YYAKEVYKIDMPPFFPSENAIPPTFY RPYFRIVRFDVSAMEKNASNLVKAEF RVFRLQNPKARVPEQRIELYQILKSK DLTSPTQRYIDSKVVKTRAEGEWLSF DVTDAVHEWLHHKDRNLGFKISLHCP CCTFVPSNNYIIPNKSEELEARFAGI DGTSTYTSGDQKTIKSTRKKNSGKTP HLLLMLLPSYRLESQQTNRRKKR | 39 |
| TGF-β3 | latency associated peptide | SLSLSTCTTLDFGHIKKKRVEAIRGQ ILSKLRLTSPPEPTVMTHVPYQVLAL YNSTRELLEEMHGEREEGCTQENTES EYYAKEIHKFDMIQGLAEHNELAVCP KGITSKVFRFNVSSVEKNRTNLFRAE FRVLRVPNPSSKRNEQRIELFQILRP DEHIAKQRYIGGKNLPTRGTAEWLSF DVTDTVREWLLRRESNLGLEISIHCP CHTFQPNGDILENIHEVMEIKFKGVD NEDDHGRGDLGRLKKQKDHHNPHLIL MMIPPHRLDNPGQGGQRKKR | 40 |
| TGF-β1 | straight jacket region | LSTCKTIDMELVKRKRIEAIRGQILS KLRLASPPSQGEVPPGPLP | 41 |
| TGF-β2 | straight jacket region | SLSTCSTLDMDQFMRKRIEAIRGQIL SKLKLTSPPEDYPEPEEVP | 42 |
| TGF-β3 | straight jacket region | SLSLSTCTTLDFGHIKKKRVEAIRGQ ILSKLRLTSPPEPTVMTHVP | 43 |
| TGF-β1 | growth factor domain | ALDTNYCFSSTEKNCCVRQLYIDFRK DLGWKWIHEPKGYHANFCLGPCPYIW SLDTQYSKVLALYNQHNPGASAAPCC VPQALEPLPIVYYVGRKPKVEQLSNM IVRSCKCS | 44 |
| TGF-β2 | growth factor domain | ALDAAYCFRNVQDNCCLRPLYIDFKR DLGWKWIHEPKGYNANFCAGACPYLW SSDTQHSRVLSLYNTINPEASASPCC VSQDLEPLTILYYIGKTPKIEQLSNM IVKSCKCS | 45 |
| TGF-β3 | growth factor domain | ALDTNYCFRNLEENCCVRPLYIDFRQ DLGWKWVHEPKGYYANFCSGPCPYLR SADTTHSTVLGLYNTLNPEASASPCC VPQDLEPLTILYYVGRTPKVEQLSNM VVKSCKCS | 46 |
| TGF-β1 | fastener region | residues 74-76, YYA | — |
| TGF-β2 | fastener region | residues 79-81, YYA | — |
| TGF-β3 | fastener region | residues 80-82, YYA | — |
| TGF-β1 | furin cleavage site region | RHRR | 47 |

TABLE 2-continued

TGF-β protein modules

| TGF-β Family Member | Protein Module | Prodomain and growth factor Sequence | SEQ ID NO |
|---|---|---|---|
| TGF-β2 | furin cleavage site region | RKKR | 48 |
| TGF-β3 | furin cleavage site region | RKKR | 48 |
| TGF-β1 | arm region | EAVLALYNSTRDRVAGESAEPEPEPE ADYYAKEVTRVLMVETHNEIYDKFKQ STHSIYMFFNTSELREAVPEPVLLSR AELRLLRLKLKVEQHVELYQKYSNNS WRYLSNRLLAPSDSPEWLSFDVTGVV RQWLSRGGEIEGFRLSAHCSCDSRDN TLQVDINGFTTGRRGDLATIHGMNRP FLLLMATPLERAQHLQSSRHRR | 49 |
| TGF-β2 | arm region | PEVISIYNSTRDLLQEKASRRAAACE RERSDEEYYAKEVYKIDMPPFFPSEN AIPPTFYRPYFRIVRFDVSAMEKNAS NLVKAEFRVFRLQNPKARVPEQRIEL YQILKSKDLTSPTQRYIDSKVVKTRA EGEWLSFDVTDAVHEWLHHKDRNLGF KISLHCPCCTFVPSNNYIIPNKSEEL EARFAGIDGTSYTSGDQKTIKSTRK KNSGKTPHLLLMLLPSYRLESQQTNR RKKR | 50 |
| TGF-β3 | arm region | YQVLALYNSTRELLEEMHGEREEGCT QENTESEYYAKEIHKFDMIQGLAEHN ELAVCPKGITSKVFRFNVSSVEKNRT NLFRAEFRVLRVPNPSSKRNEQRIEL FQILRPDEHIAKQRYIGGKNLPTRGT AEWLSFDVTDTVREWLLRRESNLGLE ISIHCPCHTFQPNGDILENIHEVMEI KFKGVDNEDDHGRGDLGRLKKQKDHH NPHLILMMIPPHRLDNPGQGGQRKKR | 51 |
| TGF-β1 | fingers region 1 | CVRQLYIDFRKDLGWKWIHEPKGYHA NFC | 52 |
| TGF-β2 | fingers region 1 | CLRPLYIDFKRDLGWKWIHEPKGYNA NFCA | 53 |
| TGF-β3 | fingers region 1 | CVRPLYIDFRQDLGWKWVHEPKGYYA NFCS | 54 |
| TGF-β1 | fingers region 2 | CVPQALEPLPIVYYVGRKPKVEQLSN MIVRSCKCS | 55 |
| TGF-β2 | fingers region 2 | CVSQDLEPLTILYYIGKTPKIEQLSN MIVKSCKCS | 56 |
| TGF-β3 | fingers region 2 | CVPQDLEPLTILYYVGRTPKVEQLSN MVVKSCKCS | 57 |
| TGF-β1 | residue for LTBP association | Cys 4 | — |
| TGF-β2 | residue for LTBP association | Cys 5 | — |
| TGF-β3 | residue for LTBP association | Cys 7 | — |
| TGF-β1 | residue for GARP association | Cys 4 | — |
| TGF-β2 | residue for GARP association | Cys 5 | — |
| TGF-β3 | residue for GARP association | Cys 7 | — |
| TGF-β1 | latency loop | LASPPSQGEVPPGPL | 58 |
| TGF-β2 | latency loop | LTSPPEDYPEPEE | 59 |
| TGF-β3 | latency loop | LTSPPEPTVMTHV | 60 |
| TGF-β1 | alpha 1 helical region | LSTCKTIDMELVKRKRIEAIRGQILS KLR | 61 |
| TGF-β2 | alpha 1 helical region | LSTCSTLDMDQFMRKRIEAIRGQILS KLK | 62 |
| TGF-β3 | alpha 1 helical region | LSLSTCTTLDFGHIKKKRVEAIRGQI LSKLR | 63 |
| TGF-β1 | trigger loop region | NGFTTGRRGDLATIHGMNRP | 64 |
| TGF-β2 | trigger loop region (long) | FAGIDGTSYTSGDQKTIKSTRKKNS GKTP | 65 |
| TGF-β3 | trigger loop region | GVDNEDDHGRGDLGRLKKQKDHHNP | 66 |
| TGF-β1 | RGD sequence region | residue 215-217, RGD | — |
| TGF-β3 | RGD sequence region | residue 241-243, RGD | — |
| TGF-β1 | bowtie region | CSCDSRDNTLQVD | 67 |
| TGF-β2 | bowtie region | CPCCTFVPSNNYIIPNKSEELEAR | 68 |
| TGF-β3 | bowtie region | CPCHTFQPNGDILENIHEVMEIK | 69 |

In some embodiments, LAPs or LAP-like domains comprise the prodomain portion of a TGF-β-related protein and/or GPC. Some LAPs or LAP-like domains may associate with growth factors in GPCs. Some LAPs may sterically prevent growth factor association with one or more cellular receptors. LAPs or LAP-like domains may comprise arm regions and/or straight jacket regions. Some LAP or LAP-like domains may comprise C-terminal regions referred to herein as "bowtie regions." In some LAP or LAP-like domain dimers, bowtie regions of each monomer may associate and/or interact. Such associations may comprise disulfide bond formation, as is found between monomers of TGF-β isoform LAPs.

In some embodiments, arm regions may comprise trigger loop regions. Trigger loops may comprise regions that associate with integrins. Such regions may comprise amino acid sequences comprising RGD (Arg-Gly-Asp). Regions comprising RGD sequences are referred to herein as RGD sequence regions. In some embodiments, LAPs or LAP-like domains comprise latency loops (also referred to herein as latency lassos). Some latency loops may maintain associations between LAPs or LAP-like domains and growth factors present within GPCs. LAPs or LAP-like domains may also comprise fastener regions. Such fastener regions may maintain associations between LAPs or LAP-like domains and growth factors present within GPCs. Some fastener regions may maintain LAP or LAP-like domain conformations that promote growth factor retention.

In some cases, GPCs may require enzymatic cleavage for dissociation of bound growth factors. Such cleavage may be carried out in some instances by members of the BMP-1/Tolloid-like proteinase (B/TP) family (Muir et al., 2011. J Biol Chem. 286(49):41905-11, the contents of which are herein incorporated by reference in their entirety.) These metaloproteinases may include, but are not limited to BMP-1, mammalian tolloid protein (mTLD,) mammalian tolloid-like 1 (mTLL1) and mammalian tolloid-like 2 (mTLL2.) Exemplary GPCs that may be cleaved by such metalloproteinases may include, but are not limited to GDF-8 and GDF-11. In some cases, GDF-8 may be cleaved by mTLL2. In some cases, tolloid cleavage may occur intracellularly. In some cases, tolloid cleavage may occur extracellularly.

Straight jacket regions may comprise alpha 1 helical regions. In some embodiments, alpha 1 helical regions may be positioned between growth factor monomers. Some alpha 1 helical regions comprise N-terminal regions of LAPs or LAP-like domains. Alpha 1 helical regions may also comprise N-terminal regions for extracellular associations. Such extracellular associations may comprise extracellular matrix proteins and/or proteins associated with the extracellular matrix. Some extracellular associations may comprise associations with proteins that may include, but are not limited to LTBPs (e.g. LTBP1, LTBP2, LTBP3 and/or LTBP4), fibrillins (e.g. fibrillin-1, fibrillin-2, fibrillin-3 and/or fibrillin-4,) perlecan, decorin and/or GARPs (e.g. GARP and/or LRRC33). N-terminal extracellular associations may comprise disulfide bonds between cysteine residues. In some cases, extracellular matrix proteins and/or proteins associated with the extraceullar matrix may comprise bonds with one or more regions of LAPs/LAP-like domains other than N-terminal regions.

In some embodiments, growth factor domains comprise one or more growth factor monomers. Some growth factor domains comprise growth factor dimers. Such growth factor domains may comprise growth factor homodimers or heterodimers (comprising growth factor monomers from different TGF-β-related proteins.) Some growth factor domains may comprise fingers regions. Such fingers regions may comprise β-pleated sheets. Fingers regions may associate with LAPs or LAP-like domains. Some fingers regions may maintain association between growth factor domains and LAPs or LAP-like domains.

In some embodiments, recombinant proteins of the present invention may comprise protein modules from growth differentiation factor (GDF) proteins. Such GDF protein modules may comprise the protein modules and/or amino acid sequences listed in Table 3. In some embodiments, protein modules of the present invention may comprise amino acid sequences similar to those in Table 3, but comprise additional or fewer amino acids than those listed. Some such amino acid sequences may comprise about 1 more or fewer amino acids, about 2 more or fewer amino acids, about 3 more or fewer amino acids, about 4 more or fewer amino acids, about 5 more or fewer amino acids, about 6 more or fewer amino acids, about 7 more or fewer amino acids, about 8 more or fewer amino acids, about 9 more or fewer amino acids, about 10 more or fewer amino acids or greater than 10 more or fewer amino acids on N-terminal and/or C-terminal ends.

TABLE 3

GDF protein modules

| TGF-β Family Member | Protein Module | Prodomain and growth factor Sequence | SEQ ID NO |
|---|---|---|---|
| GDF-8 | prodomain | NENSEQKENVEKEGLCNACTWRQNTK SSRIEAIKIQILSKLRLETAPNISKD VIRQLLPKAPPLRELIDQYDVQRDDS SDGSLEDDDYHATTETIITMPTESDF LMQVDGKPKCCFFKFSSKIQYNKVVK AQLWIYLRPVETPTTVFVQILRLIKP MKDGTRYTGIRSLKLDMNPGTGIWQS IDVKTVLQNWLKQPESNLGIEIKALD ENGHDLAVTFPGPGEDGLNPFLEVKV TDTPKRSRR | 70 |
| GDF-11 | prodomain | AEGPAAAAAAAAAAAAAGVGGERSSR PAPSVAPEPDGCPVCVWRQHSRELRL ESIKSQILSKLRLKEAPNISREVVKQ LLPKAPPLQQILDLHDFQGDALQPED FLEEDEYHATTETVISMAQETDPAVQ TDGSPLCCHFHFSPKVMFTKVLKAQL WVYLRPVPRPATVYLQILRLKPLTGE GTAGGGGGRRHIRIRSLKIELHSRS GHWQSIDFKQVLHSWFRQPQSNWGIE INAFDPSGTDLAVTSLGPGAEGLHPF MELRVLENTKRSRR | 71 |
| GDF-8 | straight jacket region | NENSEQKENVEKEGLCNACTWRQNTK SSRIEAIKIQILSKLRLETAPNISKD VIRQLLPKAPPL | 72 |
| GDF-11 | straight jacket region | AEGPAAAAAAAAAAAAAGVGGERSSR PAPSVAPEPDGCPVCVWRQHSRELRL ESIKSQILSKLRLKEAPNISREVVKQ LLPKAPPL | 73 |
| GDF-8 | growth factor domain | DFGLDCDEHSTESRCCRYPLTVDFEA FGWDWIIAPKRYKANYCSGECEFVFL QKYPHTHLVHQANPRGSAGPCCTPTK MSPINMLYFNGKEQIIYGKIPAMVVD RCGCS | 74 |
| GDF-11 | growth factor domain | NLGLDCDEHSSESRCCRYPLTVDFEA FGWDWIIAPKRYKANYCSGQCEYMFM QKYPHTHLVQQANPRGSAGPCCTPTK MSPINMLYFNDKQQIIYGKIPGMVVD RCGCS | 75 |
| GDF-8 | fastener region | residues 87-89, DYH | — |
| GDF-11 | fastener region | residues 110-112, EYH | — |
| GDF-8 | furin cleavage site region | RSRR | 76 |
| GDF-11 | furin cleavage site region | RSRR | 76 |
| GDF-8 | BMP/Tolloid cleavage site | between residues R75 and D76 | — |
| GDF-11 | BMP/Tolloid cleavage site | between residues G97 and D98 | — |
| GDF-8 | arm region | RELIDQYDVQRDDSSDGSLEDDDYHA TTETIITMPTESDFLMQVDGKPKCCF FKFSSKIQYNKVVKAQLWIYLRPVET PTTVFVQILRLIKPMKDGTRYTGIRS | 77 |

TABLE 3-continued

GDF protein modules

| TGF-β Family Member | Protein Module | Prodomain and growth factor Sequence | SEQ ID NO |
|---|---|---|---|
| GDF-11 | arm region | LKLDMNPGTGIWQSIDVKTVLQNWLK QPESNLGIEIKALDENGHDLAVTFPG PGEDGLNPFLEVKVTDTPKRSRR QQILDLHDFQGDALQPEDFLEEDEYH ATTETVISMAQETDPAVQTDGSPLCC HFHFSPKVMFTKVLKAQLWVYLRPVP RPATVYLQILRLKPLTGEGTAGGGGG GRRHIRIRSLKIELHSRSGHWQSIDF KQVLHSWFRQPQSNWGIEINAFDPSG TDLAVTSLGPGAEGLHPFMELRVLEN TKRSRR | 78 |
| GDF-8 | fingers region 1 | CRYPLTVDFEAFGWDWIIAPKRYKAN YCS | 79 |
| GDF-11 | fingers region 1 | CRYPLTVDFEAFGWDWIIAPKRYKAN YCS | 79 |
| GDF-8 | fingers region 2 | CTPTKMSPINMLYFNGKEQIIYGKIP AMVVDRCGCS | 80 |
| GDF-11 | fingers region 2 | CTPTKMSPINMLYFNDKQQIIYGKIP GMVVDRCGCS | 81 |
| GDF-8 | latency loop | RLETAPNISKDVIRQLLPKAPPL | 82 |
| GDF-11 | latency loop | RLKEAPNISREVVKQLLPKAPP | 83 |
| GDF-8 | alpha 1 helical region | GLCNACTWRQNTKSSRIEAIKIQILSK | 84 |
| GDF-11 | alpha 1 helical region | DGCPVCVWRQHSRELRLESIKSQILS KL | 85 |
| GDF-8 | bowtie region | DENGHDLAVTFPGP | 86 |
| GDF-11 | bowtie region | DPSGTDLAVTSLG | 87 |

Some recombinant proteins of the present invention may comprise GDF-15, GDF-15 signaling pathway-related proteins and/or modules and/or portions thereof. GDF-15 is a TGF-β family protein that is highly expressed in liver. Expression of GDF-15 is dramatically upregulated following liver injury (Hsiao et al. 2000. Mol Cell Biol. 20(10):3742-51.) Additionally, its expression in macrophages may serve a protective function in the context of atherosclerosis, possibly through regulation of adhesion molecule expression (Preusch et al., 2013. Eur J Med Res. 18:19.) While a member of the TGF-β family, GDF-15 comprises less than 30% homology with other members, making it the most divergent member of the family (Tanno et al., 2010. Curr Opin Hematol. 17(3):184-90, the contents of which are incorporated herein by reference in their entirety.) The mature form is soluble and can be found in the blood stream. Interestingly, GDF-15 levels in circulation have been found to negatively correlate with hepcidin levels, suggesting a role for GDF-15 in iron load and/or metabolism (Finkenstedt et al., 2008. British Journal of Haematology. 144:789-93.) Elevated GDF-15 in the blood is also associated with ineffective and/or apoptotic erythropoiesis, such as in subjects suffering from beta-thalassemia or dyserythropoietic anemias.

In some embodiments, recombinant proteins of the present invention may comprise protein modules from activin subunits. Such protein modules may comprise the protein modules and/or amino acid sequences of the activin subunit inhibin beta A, listed in Table 4. In some embodiments, protein modules of the present invention may comprise amino acid sequences similar to those in Table 4, but comprise additional or fewer amino acids than those listed. Some such amino acid sequences may comprise about 1 more or fewer amino acids, about 2 more or fewer amino acids, about 3 more or fewer amino acids, about 4 more or fewer amino acids, about 5 more or fewer amino acids, about 6 more or fewer amino acids, about 7 more or fewer amino acids, about 8 more or fewer amino acids, about 9 more or fewer amino acids, about 10 more or fewer amino acids or greater than 10 more or fewer amino acids on N-terminal and/or C-terminal ends.

TABLE 4

Inhibin beta A protein modules

| Protein Module | Prodomain and growth factor Sequence | SEQ ID NO |
|---|---|---|
| latency associated peptide (LAP) | SPTPGSEGHSAAPDCPSCALAALPKDVPNSQPE MVEAVKKHILNMLHLKKRPDVTQPVPKAALL NAIRKLHVGKVGENGYVEIEDDIGRRAEMNEL MEQTSEIITFAESGTARKTLHFEISKEGSDLSVV ERAEVWLFLKVPKANRTRTKVTIRLFQQQKHP QGSLDTGEEAEEVGLKGERSELLLSEKVVDAR KSTWHVFPVSSSIQRLLDQGKSSLDVRIACEQC QESGASLVLLGKKKKKEEEGEGKKKGGGEGG AGADEEKEQSHRPFLMLQARQSEDHPHRRRRR | 88 |
| straight jacket region | SPTPGSEGHSAAPDCPSCALAALPKDVPNSQPE MVEAVKKHILNMLHLKKRPDVTQPVPKAALLN | 89 |
| growth factor domain | RGLECDGKVNICCKKQFFVSFKDIGWNDWIIA PSGYHANYCEGECPSHIAGTSGSSLSFHSTVIN HYRMRGHSPFANLKSCCVPTKLRPMSMLYYD DGQNIIKKDIQNMIVEECGCS | 90 |
| fastener region | residues 89-91, RRA | — |
| furin cleavage site region | RRRR | 91 |
| arm region | LNAIRKLHVGKVGENGYVEIEDDIGRRAEMNE LMEQTSEIITFAESGTARKTLHFEISKEGSDLSV VERAEVWLFLKVPKANRTRTKVTIRLFQQQKH PQGSLDTGEEAEEVGLKGERSELLLSEKVVDA RKSTWHVFPVSSSIQRLLDQGKSSLDVRIACEQ CQESGASLVLLGKKKKKEEEGEGKKKGGGEG GAGADEEKEQSHRPFLMLQARQSEDHPHRRR RR | 92 |
| fingers region 1 | KKQFFVSFKDIGWNDWIIAPSGYHANYC | 93 |
| fingers region 2 | CVPTKLRPMSMLYYDDGQNIIKKDIQNMIVEE CGCS | 94 |
| latency loop | LKKRPDVTQPVPKAALL | 95 |
| alpha 1 helical region | ALAALPKDVPNSQPEMVEAVKKHILNML | 96 |
| bowtie region | QESGASLVLLGKKKKKEEEGEGKKKGGGEGG AG | 97 |

Growth factor domains among TGF-β family members are more highly conserved while prodomains comprise a much lower percent identity among family members (FIG. 9.) Table 5 demonstrates this trend among TGF-β isoforms.

TABLE 5

Percent identity among TGF-β isoforms: LAP vs growth factor

|  | TGF-β1 | TGF-β2 | TGF-β3 |
|---|---|---|---|
| TGF-β1 | — | 31.2% vs 71.2% | 31.9% vs 76.7% |
| TGF-β2 | 31.2% vs 71.2% | — | 44.4% vs 79.4% |
| TGF-β3 | 31.9% vs 76.7% | 44.4% vs 79.4% | — |

Prodomains may vary in length from about 50 to about 200, from about 100 to about 400 or from about 300 to about 500 amino acids residues. In some embodiments, prodomains range from about 169 to about 433 residues. Prodomains may be unrelated in sequence and/or low in homology. Some prodomains may have similar folds and/or three dimensional structures. Prodomains of TGF-β family members may comprise latency loops. Such loops may be proline-rich. Latency loop length may determine the ability of such loops to encircle growth factor finger regions.

In some embodiments, protein modules from some TGF-β family members comprise low sequence identity with protein modules from other TGF-β family members. Such low sequence identity may indicate specialized roles for such family members with distinct protein modules.

Association of GPCs with extracellular proteins may strengthen prodomain-growth factor interactions. In some embodiments, such extracellular proteins may include, but are not limited to LTBPs, fibrillins and/or GARP. In some cases, extracellular protein associations are required to keep growth factors latent in GPCs.

GARP expression has been shown to be required for surface expression of GPCs on the surface of cells of hematopoietic origin (Tran, D. Q. et al., GARP (LRRC32) is essential for the surface expression of latent TGF-β on platelets and activated FOXP3+ regulatory T cells. PNAS. 2009, Jun. 2. 106(32):13445-50.) GARP may act as a tether to hold GPCs in place on the surface of these cells, including, but not limited to regulatory T-cells and/or platelets.

In some embodiments, recombinant proteins of the present invention may comprise bone morphogenetic proteins (BMPs), a family of TGF-β-related proteins. Protein modules comprising sequences from BMPs may comprise sequences from any of those BMP modules disclosed in FIGS. 8A-8G. While related to other TGF-β family member proteins, BMPs generally signal through SMAD1, 5 and 8 proteins while TGF-β isoforms (e.g. TGF-β1, TGF-β2 and TGF-β3) signal through SMAD2 and SMAD3.

Some BMP receptors and/or co-receptors are also distinct from other TGF-β family member proteins. Among these is the repulsive guidance molecule (RGM) family of proteins. RGM proteins act as co-receptors for BMP signaling. There are three RGM family members, RGMA, RGMB and RGMC [also known as hemojuvelin (Hjv.)] Recombinant proteins of the present invention comprising one or more BMP protein module may be useful for the development of antibodies and/or assays to study, enhance and/or perturb BMP interactions with RGM proteins.

Another family of GDF/BMP interacting proteins is C-terminal cysteine knot-like (CTCK) domain-containing proteins. In some cases, CTCK domain-containing proteins may act antagonistically with regard to GDF/BMP signal transduction. CTCK domain-containing proteins include, but are not limited to Cerberus, Connective tissue growth factor (CTGF), DAN domain family member 5 (DAND5), Gremlin-1 (GREM1), Gremlin-2 (GREM2), Mucin-19 (MUC19), Mucin-2 (MUC2), Mucin-5AC (MUC5AC), Mucin-5B (MUC5B), Mucin-6 (MUC6), Neuroblastoma suppressor of tumorigenicity 1 (NBL1), Norrin (NDP), Otogelin (OTOG), Otogelin-like protein (OTOGL), Protein CYR61 (CYR61), Protein NOV homolog (NOV), Sclerostin (SOST), Sclerostin domain-containing protein 1 (SOSTDC1), SCO-spondin (SSPO), Slit homolog 1 protein (SLIT1), Slit homolog 2 protein (SLIT2), Slit homolog 3 protein (SLIT3), von Willebrand factor (VWF), WNT1-inducible-signaling pathway protein 1 (WISP1) and WNT1-inducible-signaling pathway protein 3 (WISP3).

Recombinant Proteins

In some embodiments, the present invention provides recombinant proteins. As used herein, the term "recombinant protein" refers to a protein produced by an artificial gene and/or process (e.g. genetic engineering). Such recombinant proteins may comprise one or more protein modules from one or more TGF-β-related proteins. Some recombinant proteins disclosed herein may be useful as recombinant antigens. As used herein, the term "recombinant antigen" refers to a recombinant protein that may be used to immunize one or more hosts for the production of antibodies directed toward one or more epitopes present on such recombinant antigens. Some recombinant antigens may be cell-based antigens. As used herein, the term "cell-based antigen" refers to recombinant antigens that are expressed in cells for presentation of such antigens on the cell surface. Such cells may be used to immunize hosts for the production of antibodies directed to such cell-based antigens.

In some embodiments, recombinant proteins disclosed herein may be used as therapeutics. Recombinant proteins disclosed herein may modulate growth factor (e.g. growth factors comprising TGF-β-related proteins) levels and/or activity (e.g. signaling) upon administration and/or introduction to one or more subjects and/or niches.

In some embodiments, recombinant proteins disclosed herein may be used to assay growth factor (e.g. growth factors comprising TGF-β-related proteins) levels and/or activity (e.g. signaling). Some recombinant proteins disclosed herein may be used in the isolation of antibodies directed to TGF-β-related proteins. Recombinant proteins of the present invention may also be used as recombinant antigens in the development of stabilizing [reducing or preventing dissociation between two agents, (e.g. growth-factor release from GPCs, GPC release from one or more protein interactions)] and/or releasing [enhancing the dissociation between two agents (e.g. growth-factor release from GPCs, GPC release from one or more protein interactions)] antibodies. Recombinant proteins of the present invention may include TGF-β family member proteins as well as components and/or protein modules thereof. Some recombinant proteins of the present invention may comprise prodomains without associated growth factors, furin cleavage-deficient mutants, mutants deficient in extracellular protein associations and/or combinations thereof.

In some embodiments, recombinant proteins may comprise detectable labels. Detectable labels may be used to allow for detection and/or isolation of recombinant proteins. Some detectable labels may comprise biotin labels, polyhistidine tags and/or flag tags. Such tags may be used to isolate tagged proteins. Proteins produced may comprise additional amino acids encoding one or more 3C protease cleavage site. Such sites allow for cleavage at the 3C protease cleavage site upon treatment with 3C protease, including, but not limited to rhinovirus 3C protease. Such cleavage sites are introduced to allow for removal of detectable labels from recombinant proteins.

Recombinant GPCs

FIG. 5 is a schematic depicting an embodiment of a recombinant GPC. Recombinant proteins according to FIG. 5 comprising TGF-β-family member proteins may comprise features including, but not limited to C-terminal regions of the mature growth factor, N-terminal regions of the prodomain and/or proprotein cleavage sites. The proprotein cleavage site of recombinant TGF-β GPCs may, for example, comprise the furin consensus sequence RXXR wherein R is arginine and X indicates amino acid residues that may vary among TGF-β family members. Furin cleavage site sequences (although not limited to cleavage by furin alone and may include cleavage by other proprotein convertase enzymes) for each TGF-β family member are indicated in Table 1. Recombinant GPCs according to the embodiment depicted in FIG. 5 may also comprise one or more cysteine residues within and/or near the N-terminal region of the prodomain. Such cysteine residues may be from about 1 to about 10 amino acids, from about 4 to about 15 amino acids, from about 5 to about 20 amino acids and/or from about 7 to about 50 amino acids from the N-terminus of the prodomain. Recombinant GPCs may also comprise detectable labels. Such detectable labels may be useful for detection and/or isolation of recombinant GPCs. Detectable labels may comprise 2 or more histidine (His) residues. Such detectable labels may also be referred to herein as polyhistidine tags. Polyhistidine tags may include hexa histidine tags (SEQ ID NO: 295) or HIS-TAG™ (EMD Biosciences, Darmstadt, Germany) comprising a chain of six histidine residues (SEQ ID NO: 295). Some polyhistidine tags may be present at the N-terminus of recombinant proteins disclosed herein. Some polyhistidine tags may be present at the C-terminus of recombinant proteins disclosed herein. Proteins produced may comprise additional amino acids encoding one or more 3C protease cleavage site. Such sites allow for cleavage at the 3C protease cleavage site upon treatment with 3C protease, including, but not limited to rhinovirus 3C protease. Some cleavage sites may be introduced to allow for removal of detectable labels from recombinant proteins.

In some embodiments of the present invention, recombinant GPCs may comprise mutations in one or more amino acids as compared to wild type sequences. In some cases, one or more regions of proteolytic processing may be mutated. Such regions may comprise proprotein convertase cleavage sites. Proprotein convertase (e.g. furin) cleavage site mutations prevent enzymatic cleavage at that site and/or prevent enzymatic cleavage of growth factors from their prodomains (see FIG. 6.) Some proprotein convertase cleavage sites comprising RXXR sequences may be mutated to RXG (wherein X indicates a site where amino acid residues may be variable). Such mutations are herein abbreviated as "D2G" mutations and may be resistant to enzymatic cleavage. In some embodiments, furin cleavage sites comprising RXXR sequences are mutated to AXXA. Such AXXA sequences may also be resistant to enzymatic cleavage.

In some embodiments, regions of proteolytic processing by tolloid and/or tolloid-like proteins may be mutated to prevent such proteolytic processing. In some embodiments, tolloid processing regions on GDF-8 and/or GDF-11 may be mutated. In some embodiments, mutation of aspartic acid residues to alanine residues within tolloid processing regions prevents tolloid processing. Mutation of aspartic acid residue 76 (D76) of the GDF-8 (myostatin) proprotein has been shown to prevent proteolytic activation of latent GDF-8 (Wolfman, N. M. et al., PNAS. 2003, Oct. 6. 100(26):15842-6.) In some embodiments, Asp 120 (D120, residue number counted from the translated protein, D98 from the proprotein of SEQ ID NO: 4) in GDF-11 may be mutated to prevent tolloid processing (Ge et al., 2005. Mol Cell Biol. 25(14): 5846-58, the contents of which are herein incorporated by reference in their entirety.)

In some embodiments, one or more amino acids may be mutated in order to form recombinant GPCs with reduced latency. Such mutations are referred to herein as "activating mutations." These mutations may introduce one or more regions of steric clash between complex prodomains and growth factor domains. As used herein, the term "steric clash," when referring to the interaction between two proteins or between two domains and/or epitopes within the same protein, refers to a repulsive interaction between such proteins, domains and/or epitopes due to overlapping position in three-dimensional space. Steric clash within GPCs may reduce the affinity between prodomains and growth factor domains, resulting in elevated ratios of free growth factor to latent growth factor. In some embodiments, one or more amino acids may be mutated in order to form recombinant GPCs with increased latency. Such mutations are referred to herein as "stabilizing mutations." These mutations may increase the affinity between prodomains and growth factor domains, resulting in decreased ratios of free growth factor to latent growth factor.

In some embodiments, recombinant proteins of the present invention may comprise any of the sequences listed in Table 6 or fragments thereof

TABLE 6

Recombinant proteins

| Protein | Sequence | SEQ ID NO |
|---|---|---|
| proTGF-β1 | LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS | 1 |
| proTGF-β1 C4S | LSTSKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS | 98 |
| proTGF-β1 C4S (LAP) | LSTSKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRR | 99 |
| proTGF-β1 D2G | LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSS | 100 |

TABLE 6-continued Recombinant proteins

| Protein | Sequence | SEQ ID NO |
|---|---|---|
| | RHGALDTNYCFSSTEKNCCVRQLYIDFRKDLGWKW IHEPKGYHANFCLGPCPYIWSLDTQYSKVLALYNQ HNPGASAAPCCVPQALEPLPIVYYVGRKPKVEQLS NMIVRSCKCS | |
| proTGF-β1 C4S D2G | LSTSKTIDMELVKRKRIEAIRGQILSKLRLASPPS QGEVPPGPLPEAVLALYNSTRDRVAGESAEPEPEP EADYAKEVTRVLMVETHNEIYDKFKQSTHSIYMF FNTSELREAVPEPVLLSRAELRLLRLKLKVEQHVE LYQKYSNNSWRYLSNRLLAPSDSPEWLSFDVTGVV RQWLSRGGEIEGFRLSAHCSCDSRDNTLQVDINGF TTGRRGDLATIHGMNRPFLLLMATPLERAQHLQSS RHGALDTNYCFSSTEKNCCVRQLYIDFRKDLGWKW IHEPKGYHANFCLGPCPYIWSLDTQYSKVLALYNQ HNPGASAAPCCVPQALEPLPIVYYVGRKPKVEQLS NMIVRSCKCS | 101 |
| proTGF-β1 LAP | LSTCKTIDMELVKRKRIEAIRGQILSKLRLASPPS QGEVPPGPLPEAVLALYNSTRDRVAGESAEPEPEP EADYAKEVTRVLMVETHNEIYDKFKQSTHSIYMF FNTSELREAVPEPVLLSRAELRLLRLKLKVEQHVE LYQKYSNNSWRYLSNRLLAPSDSPEWLSFDVTGVV RQWLSRGGEIEGFRLSAHCSCDSRDNTLQVDINGF TTGRRGDLATIHGMNRPFLLLMATPLERAQHLQSS RHRR | 38 |
| proTGF-β2 | SLSTCSTLDMDQFMRKRIEAIRGQILSKLKLTSPP EDYPEPEEVPPEVISIYNSTRDLLQEKASRRAAAC ERERSDEEYYAKEVYKIDMPPFFPSENAIPPTFYR PYFRIVRFDVSAMEKNASNLVKAEFRVFRLQNPKA RVPEQRIELYQILKSKDLTSPTQRYIDSKVVKTRA EGEWLSFDVTDAVHEWLHHKDRNLGFKISLHCPCC TFVPSNNYIIPNKSEELEARFAGIDGTSTYTSGDQ KTIKSTRKKNSGKTPHLLLMLLPSYRLESQQTNRR KKRALDAAYCFRNVQDNCCLRPLYIDFKRDLGWKW IHEPKGYNANFCAGACPYLWSSDTQHSRVLSLYNT INPEASASPCCVSQDLEPLTILYYIGKTPKIEQLS NMIVKSCKCS | 2 |
| proTGF-β2 C5S | SLSTSSTLDMDQFMRKRIEAIRGQILSKLKLTSPP EDYPEPEEVPPEVISIYNSTRDLLQEKASRRAAAC ERERSDEEYYAKEVYKIDMPPFFPSENAIPPTFYR PYFRIVRFDVSAMEKNASNLVKAEFRVFRLQNPKA RVPEQRIELYQILKSKDLTSPTQRYIDSKVVKTRA EGEWLSFDVTDAVHEWLHHKDRNLGFKISLHCPCC TFVPSNNYIIPNKSEELEARFAGIDGTSTYTSGDQ KTIKSTRKKNSGKTPHLLLMLLPSYRLESQQTNRR KKRALDAAYCFRNVQDNCCLRPLYIDFKRDLGWKW IHEPKGYNANFCAGACPYLWSSDTQHSRVLSLYNT INPEASASPCCVSQDLEPLTILYYIGKTPKIEQLS NMIVKSCKCS | 102 |
| pro TGF-β2 LAP C5 | SSLSTSSTLDMDQFMRKRIEAIRGQILSKLKLTSP PEDYPEPEEVPPEVISIYNSTRDLLQEKASRRAAA CERERSDEEYYAKEVYKIDMPPFFPSENAIPPTFY RPYFRIVRFDVSAMEKNASNLVKAEFRVFRLQNPK ARVPEQRIELYQILKSKDLTSPTQRYIDSKVVKTR AEGEWLSFDVTDAVHEWLHHKDRNLGFKISLHCPC CTFVPSNNYIIPNKSEELEARFAGIDGTSTYTSGD QKTIKSTRKKNSGKTPHLLLMLLPSYRLESQQTNR RKKR | 103 |
| pro TGF-β2 C5S D2G | SLSTSSTLDMDQFMRKRIEAIRGQILSKLKLTSPP EDYPEPEEVPPEVISIYNSTRDLLQEKASRRAAAC ERERSDEEYYAKEVYKIDMPPFFPSENAIPPTFYR PYFRIVRFDVSAMEKNASNLVKAEFRVFRLQNPKA RVPEQRIELYQILKSKDLTSPTQRYIDSKVVKTRA EGEWLSFDVTDAVHEWLHHKDRNLGFKISLHCPCC TFVPSNNYIIPNKSEELEARFAGIDGTSTYTSGDQ KTIKSTRKKNSGKTPHLLLMLLPSYRLESQQTNRR KGALDAAYCFRNVQDNCCLRPLYIDFKRDLGWKWI HEPKGYNANFCAGACPYLWSSDTQHSRVLSLYNTI NPEASASPCCVSQDLEPLTILYYIGKTPKIEQLSN MIVKSCKCS | 104 |
| proTGF-β2 D2G | SLSTCSTLDMDQFMRKRIEAIRGQILSKLKLTSPP EDYPEPEEVPPEVISIYNSTRDLLQEKASRRAAAC ERERSDEEYYAKEVYKIDMPPFFPSENAIPPTFYR PYFRIVRFDVSAMEKNASNLVKAEFRVFRLQNPKA RVPEQRIELYQILKSKDLTSPTQRYIDSKVVKTRA EGEWLSFDVTDAVHEWLHHKDRNLGFKISLHCPCC TFVPSNNYIIPNKSEELEARFAGIDGTSTYTSGDQ KTIKSTRKKNSGKTPHLLLMLLPSYRLESQQTNRR KGALDAAYCFRNVQDNCCLRPLYIDFKRDLGWKWI HEPKGYNANFCAGACPYLWSSDTQHSRVLSLYNTI NPEASASPCCVSQDLEPLTILYYIGKTPKIEQLSN MIVKSCKCS | 105 |
| proTGF-β2 LAP | SLSTCSTLDMDQFMRKRIEAIRGQILSKLKLTSPP EDYPEPEEVPPEVISIYNSTRDLLQEKASRRAAAC ERERSDEEYYAKEVYKIDMPPFFPSENAIPPTFYR PYFRIVRFDVSAMEKNASNLVKAEFRVFRLQNPKA RVPEQRIELYQILKSKDLTSPTQRYIDSKVVKTRA EGEWLSFDVTDAVHEWLHHKDRNLGFKISLHCPCC TFVPSNNYIIPNKSEELEARFAGIDGTSTYTSGDQ KTIKSTRKKNSGKTPHLLLMLLPSYRLESQQTNRR KKR | 39 |
| proTGF-β3 | SLSLSTCTTLDFGHIKKKRVEAIRGQILSKLRLTS PPEPTVMTHVPYQVLALYNSTRELLEEMHGEREEG CTQENTESEYYAKEIHKFDMIQGLAEHNELAVCPK GITSKVFRFNVSSVEKNRTNLFRAEFRVLRVPNPS SKRNEQRIELFQILRPDEHIAKQRYIGGKNLPTRG TAEWLSFDVTDTVREWLLRRESNLGLEISIHCPCH TFQPNGDILENIHEVMEIKFKGVDNEDDHGRGDLG RLKKQKDHHNPHLILMMIPPHRLDNPGQGGGQRKKR ALDTNYCFRNLEENCCVRPLYIDFRQDLGWKVVHE PKGYYANFCSGPCPYLRSADTTHSTVLGLYNTLNP EASASPCCVPQDLEPLTILYYVGRTPKVEQLSNMV VKSCKCS | 3 |
| proTGF-β3 C7S | SLSLSTTTLDFGHIKKKRVEAIRGQILSKLRLTS PPEPTVMTHVPYQVLALYNSTRELLEEMHGEREEG CTQENTESEYYAKEIHKFDMIQGLAEHNELAVCPK GITSKVFRFNVSSVEKNRTNLFRAEFRVLRVPNPS SKRNEQRIELFQILRPDEHIAKQRYIGGKNLPTRG TAEWLSFDVTDTVREWLLRRESNLGLEISIHCPCH TFQPNGDILENIHEVMEIKFKGVDNEDDHGRGDLG RLKKQKDHHNPHLILMMIPPHRLDNPGQGGGQRKKR ALDTNYCFRNLEENCCVRPLYIDFRQDLGWKVVHE PKGYYANFCSGPCPYLRSADTTHSTVLGLYNTLNP EASASPCCVPQDLEPLTILYYVGRTPKVEQLSNMV VKSCKCS | 106 |
| pro TGF-β3 LAP C7S | SLSLSTTTLDFGHIKKKRVEAIRGQILSKLRLTS PPEPTVMTHVPYQVLALYNSTRELLEEMHGEREEG CTQENTESEYYAKEIHKFDMIQGLAEHNELAVCPK GITSKVFRFNVSSVEKNRTNLFRAEFRVLRVPNPS SKRNEQRIELFQILRPDEHIAKQRYIGGKNLPTRG TAEWLSFDVTDTVREWLLRRESNLGLEISIHCPCH TFQPNGDILENIHEVMEIKFKGVDNEDDHGRGDLG RLKKQKDHHNPHLILMMIPPHRLDNPGQGGGQRKKR | 107 |
| proTGF-β3 C7S D2G | SLSLSTTTLDFGHIKKKRVEAIRGQILSKLRLTS PPEPTVMTHVPYQVLALYNSTRELLEEMHGEREEG CTQENTESEYYAKEIHKFDMIQGLAEHNELAVCPK GITSKVFRFNVSSVEKNRTNLFRAEFRVLRVPNPS SKRNEQRIELFQILRPDEHIAKQRYIGGKNLPTRG TAEWLSFDVTDTVREWLLRRESNLGLEISIHCPCH TFQPNGDILENIHEVMEIKFKGVDNEDDHGRGDLG RLKKQKDHHNPHLILMMIPPHRLDNPGQGGGQRKGA LDTNYCFRNLEENCCVRPLYIDFRQDLGWKVVHEP KGYYANFCSGPCPYLRSADTTHSTVLGLYNTLNPE ASASPCCVPQDLEPLTILYYVGRTPKVEQLSNMVV KSCKCS | 108 |
| proTGF-β3 D2G | SLSLSTCTTLDFGHIKKKRVEAIRGQILSKLRLTS PPEPTVMTHVPYQVLALYNSTRELLEEMHGEREEG | 109 |

TABLE 6-continued

Recombinant proteins

| Protein | Sequence | SEQ ID NO |
|---|---|---|
|  | CTQENTESEYYAKEIHKFDMIQGLAEHNELAVCPK GITSKVFRFNVSSVEKNRTNLFRAEFRVLRVPNPS SKRNEQRIELFQILRPDEHIAKQRYIGGKNLPTRG TAEWLSFDVTDTVREWLLRRESNLGLEISIHCPCH TFQPNGDILENIHEVMEIKFKGVDNEDDHGRGDLG RLKKQKDHHNPHLILMMIPPHRLDNPGQGGQRKGA LDTNYCFRNLEENCCVRPLYIDFRQDLGWKWVHEP KGYYANFCSGPCPYLRSADTTHSTVLGLYNTLNPE ASASPCCVPQDLEPLTILYYVGRTPKVEQLSNMVV KSCKCS |  |
| proTGF-β3 LAP | SLSLSTCTTLDFGHIKKKRVEAIRGQILSKLRLTS PPEPTVMTHVPYQVLALYNSTRELLEEMHGEREEG CTQENTESEYYAKEIHKFDMIQGLAEHNELAVCPK GITSKVFRFNVSSVEKNRTNLFRAEFRVLRVPNPS SKRNEQRIELFQILRPDEHIAKQRYIGGKNLPTRG TAEWLSFDVTDTVREWLLRRESNLGLEISIHCPCH TFQPNGDILENIHEVMEIKFKGVDNEDDHGRGDLG RLKKQKDHHNPHLILMMIPPHRLDNPGQGGQRKKR | 40 |

In some embodiments, activating mutations may comprise residues critical for LAP or LAP-like protein dimerization. Some activating mutations may comprise TGF-β isoforms (TGF-β1, TGF-β2 and/or TGF-β3). Mutant GPCs with activating mutations may comprise mutations that correspond to mutations identified in Camurati-Engelmann disease (CED). Subjects suffering from CED typically have genetic defects in TGF-β1. Mutations identified in such subjects include, but are not limited to mutations in residues Y81, 8218, H222, C223 and C225. Residues C223 and C225 are necessary for disulfide bond formation in LAP dimerization. Mutations to 8218, H222, C223 and/or C225 may lead to weakened or disrupted disulfide bond formation and LAP dimerization. In some embodiments, CED mutations lead to elevated release of TGF-β and/or increased TGF-β activity. In some embodiments, recombinant GPCs comprising TGF-β1 with CED mutations comprise sequences listed in Table 7. The amino acid substitutions indicated in these proteins reflect the residue number as counted from the start of the translated protein (before removal of the secretion signal sequence).

TABLE 7

Recombinant GPCs with Camurati-Engelmann mutations

| Protein | Sequence | SEQ ID NO |
|---|---|---|
| proTGF-β1 Y81H | LSTCKTIDMELVKRKRIEAIRGQILSKLRLASPPS QGEVPPGPLPEAVLALHNSTRDRVAGESAEPEPEP EADYYAKEVTRVLMVETHNEIYDKFKQSTHSIYMF FNTSELREAVPEPVLLSRAELRLLRLKLKVEQHVE LYQKYSNNSWRYLSNRLLAPSDSPEWLSFDVTGVV RQWLSRGGEIEGFRLSAHCSCDSRDNTLQVDINGF TTGRRGDLATIHGMNRPFLLLMATPLERAQHLQSS RHRRALDTNYCFSSTEKNCCVRQLYIDFRKDLGWK WIHEPKGYHANFCLGPCPYIWSLDTQYSKVLALYN QHNPGASAAPCCVPQALEPLPIVYYVGRKPKVEQL SNMIVRSCKCS | 110 |
| proTGF-β1 R218C | LSTCKTIDMELVKRKRIEAIRGQILSKLRLASPPS QGEVPPGPLPEAVLALYNSTRDRVAGESAEPEPEP EADYYAKEVTRVLMVETHNEIYDKFKQSTHSIYMF FNTSELREAVPEPVLLSRAELRLLRLKLKVEQHVE LYQKYSNNSWRYLSNRLLAPSDSPEWLSFDVTGVV RQWLSRGGEIEGFCLSAHCSCDSRDNTLQVDINGF TTGRRGDLATIHGMNRPFLLLMATPLERAQHLQSS RHRRALDTNYCFSSTEKNCCVRQLYIDFRKDLGWK WIHEPKGYHANFCLGPCPYIWSLDTQYSKVLALYN QHNPGASAAPCCVPQALEPLPIVYYVGRKPKVEQL SNMIVRSCKCS | 111 |
| proTGF-β1 H222D | LSTCKTIDMELVKRKRIEAIRGQILSKLRLASPPS QGEVPPGPLPEAVLALYNSTRDRVAGESAEPEPEP EADYYAKEVTRVLMVETHNEIYDKFKQSTHSIYMF FNTSELREAVPEPVLLSRAELRLLRLKLKVEQHVE LYQKYSNNSWRYLSNRLLAPSDSPEWLSFDVTGVV RQWLSRGGEIEGFRLSADCSCDSRDNTLQVDINGF TTGRRGDLATIHGMNRPFLLLMATPLERAQHLQSS RHRRALDTNYCFSSTEKNCCVRQLYIDFRKDLGWK WIHEPKGYHANFCLGPCPYIWSLDTQYSKVLALYN QHNPGASAAPCCVPQALEPLPIVYYVGRKPKVEQL SNMIVRSCKCS | 112 |
| proTGF-β1 C223R | LSTCKTIDMELVKRKRIEAIRGQILSKLRLASPPS QGEVPPGPLPEAVLALYNSTRDRVAGESAEPEPEP EADYYAKEVTRVLMVETHNEIYDKFKQSTHSIYMF FNTSELREAVPEPVLLSRAELRLLRLKLKVEQHVE LYQKYSNNSWRYLSNRLLAPSDSPEWLSFDVTGVV RQWLSRGGEIEGFRLSAHRSCDSRDNTLQVDINGF TTGRRGDLATIHGMNRPFLLLMATPLERAQHLQSS RHRRALDTNYCFSSTEKNCCVRQLYIDFRKDLGWK WIHEPKGYHANFCLGPCPYIWSLDTQYSKVLALYN QHNPGASAAPCCVPQALEPLPIVYYVGRKPKVEQL SNMIVRSCKCS | 113 |
| proTGF-β1 C225R | LSTCKTIDMELVKRKRIEAIRGQILSKLRLASPPS QGEVPPGPLPEAVLALYNSTRDRVAGESAEPEPEP EADYYAKEVTRVLMVETHNEIYDKFKQSTHSIYMF FNTSELREAVPEPVLLSRAELRLLRLKLKVEQHVE LYQKYSNNSWRYLSNRLLAPSDSPEWLSFDVTGVV RQWLSRGGEIEGFRLSAHCSRDSRDNTLQVDINGF TTGRRGDLATIHGMNRPFLLLMATPLERAQHLQSS RHRRALDTNYCFSSTEKNCCVRQLYIDFRKDLGWK WIHEPKGYHANFCLGPCPYIWSLDTQYSKVLALYN QHNPGASAAPCCVPQALEPLPIVYYVGRKPKVEQL SNMIVRSCKCS | 114 |
| proTGF-β1 C223R C225R | LSTCKTIDMELVKRKRIEAIRGQILSKLRLASPPS QGEVPPGPLPEAVLALYNSTRDRVAGESAEPEPEP EADYYAKEVTRVLMVETHNEIYDKFKQSTHSIYMF FNTSELREAVPEPVLLSRAELRLLRLKLKVEQHVE LYQKYSNNSWRYLSNRLLAPSDSPEWLSFDVTGVV RQWLSRGGEIEGFRLSAHRSRDSRDNTLQVDINGF TTGRRGDLATIHGMNRPFLLLMATPLERAQHLQSS RHRRALDTNYCFSSTEKNCCVRQLYIDFRKDLGWK WIHEPKGYHANFCLGPCPYIWSLDTQYSKVLALYN QHNPGASAAPCCVPQALEPLPIVYYVGRKPKVEQL SNMIVRSCKCS | 115 |

GPCs comprising CED mutations may find several uses in the context of the present invention. In some embodiments, such GPCs may be used to produce recombinant proteins comprising LAPs or LAP-like domains complexed with GARP. Coexpression of the entire GPC with GARP may be necessary in some embodiments, for proper association and folding. Through expression of GPCs comprising CED mutations, growth factors may be able to dissociate leaving the desired GARP-LAP complex. Y81H mutations may be useful in this regard. Y81H mutations lead to growth factor release, but do not disrupt disulfide bonding between LAP monomers at residues C223 and C225. Therefore, GARP-LAP complexes formed through expression of Y81H GPC mutants may comprise intact LAP dimers wherein growth factors have become dissociated. In some embodiments, additional co-expression or addition of excess furin during the production process may enhance growth factor dissociation as well.

GPCs comprising CED mutations may be expressed to allow for the production and release of mature growth factor. Some GPC-free growth factors expressed according to this method may be used to assess antibody reactivity, for example in enzyme-linked immunosorbent assays (ELISAs.) Some GPCs comprising CED mutations may be expressed to allow for the production and release of GPC-bound growth factors. GPCs comprising CED mutations may be expressed to allow for the production and release of chimeric proteins comprising the TGF-β1 LAP (or protein modules or fragments thereof) expressed with one or more protein modules from other TGF-β family members. Such chimeric proteins may comprise TGF-β1 LAP and TGF-β2 or TGF-β3 growth factor domains.

Furin cleavage of recombinant proteins of the invention may in some cases occur intracellularly. In some cases furin cleavage of recombinant proteins of the invention may occur extracellularly.

In some embodiments, recombinant GPCs of the present invention may comprise mutations in one or more N-terminal regions for extracellular associations. As used herein, the term "N-terminal region for extracellular association" refers to regions at or near protein N-termini that may be necessary for extracellular associations with one or more N-terminal regions. Such regions may comprise at least the first N-terminal residue, at least the first 5 N-terminal residues, at least the first 10 N-terminal residues, at least the first 20 amino acid residues and/or at least the first 50 amino acid residues. Some mutations may comprise from about 1 amino acid residue to about 30 amino acid residues, from about 5 amino acid residues to about 40 amino acid residues and/or from about 10 amino acid residues to about 50 amino acid residues at or near protein N-termini. Such regions may comprise residues for LTBP, fibrillin and/or GARP association. In some cases, one or more cysteine residues present within and/or near N-terminal regions for extracellular associations may be necessary for such associations. In some embodiments, cysteine residues present within and/or near N-terminal regions for extracellular associations are present within about the first 2 N-terminal residues, about the first 3 N-terminal residues, about the first 4 N-terminal residues, about the first 5 N-terminal residues, about the first 6 N-terminal residues, about the first 7 N-terminal residues and/or at least the first 30 N-terminal residues. Some mutations in one or more N-terminal regions for extracellular associations comprise substitution and/or deletion of such cysteine residues. Such mutations may modulate the association of GPCs and/or prodomains with one or more extracellular proteins, including, but not limited to LTBPs, fibrillins and/or GARP. These mutations may also comprise substitution of one or more cysteine with another amino acid. Cysteine residue substitutions are abbreviated herein as "C#X" wherein # represents the residue number [counting from the N-terminus of the pro-protein (without the signal peptide)] of the original cysteine residue and X represents the one letter amino acid code for the amino acid that is used for substitution. Any amino acid may be used for such substitutions. In some cases, serine (S) residues are used to substitute cysteine residues. Nonlimiting examples of such mutations may include C4S, C5S and/or C7S. In recombinant GPCs comprising N-terminal prodomain regions from TGF-β1, cysteine residues residing at amino acid position number 4 may be mutated. In recombinant GPCs comprising N-terminal prodomain regions from TGF-β2, cysteine residues residing at amino acid position number 5 may be mutated In recombinant GPCs comprising N-terminal prodomain regions from TGF-β3, cysteine residues at position 7 may be mutated.

In some cases, one or more cysteine in one or more other region of GPCs may be substituted or deleted. In some embodiments, such GPC modifications may promote the release of mature growth factor from prodomains. In some cases, such cysteines may include those present in one or more of mature growth factors, alpha 2 helices, fasteners, latency lassos and/or bow-tie regions.

In some embodiments, recombinant proteins of the present invention may comprise protein modules derived from one or more species, including mammals, including, but not limited to mice, rats, rabbits, pigs, monkeys and/or humans. Recombinant proteins may comprise one or more amino acids from one or more amino acid sequences derived from one or more non-human protein sequences listed in Table 8. In some cases, recombinant proteins of the present invention may comprise such sequences with or without the native signal peptide.

TABLE 8

Non-human proteins

| Protein | Species | Sequence | SEQ ID NO |
|---|---|---|---|
| proTGF-β1 | Mouse | LSTCKTIDMELVKRKRIEAIRGQILSKLRLASPPSQGEVPP GPLPEAVLALYNSTRDRVAGESADPEPEPEADYYAKEV TRVLMVDRNNAIYEKTKDISHSIYMFFNTSDIREAVPEPP LLSRAELRLQRLKSSVEQHVELYQKYSNNSWRYLGNRL LTPTDTPEWLSFDVTGVVRQWLNQGDGIQGFRFSAHCS CDSKDNKLHVEINGISPKRRGDLGTIHDMNRPFLLLMAT PLERAQHLHSSRHRRALDTNYCFSSTEKNCCVRQLYIDF RKDLGWKWIHEPKGYHANFCLGPCPYIWSLDTQYSKVL ALYNQHNPGASASPCCVPQALEPLPIVYYVGRKPKVEQ LSNMIVRSCKCS | 116 |
| proTGF-β1 | Cyno | LSTCKTIDMELVKRKRIEAIRGQILSKLRLASPPSQGEVPP GPLPEAVLALYNSTRDRVAGESAEPEPEPEADYYAKEVT RVLMVETHNEIYDKFKQSTHSIYMFFNTSELREAVPEPV LLSRAELRLLRLKLKVEQHVELYQKYSNNSWRYLSNRL LAPSDSPEWLSFDVTGVVRQWLSRGGEIEGFRLSAHCSC DSKDNTLQVDINGFTTGRRGDLATIHGMNRPFLLLMAT PLERAQHLQSSRHRRALDTNYCFSSTEKNCCVRQLYIDF RKDLGWKWIHEPKGYHANFCLGPCPYIWSLDTQYSKVL ALYNQHNPGASAAPCCVPQALEPLPIVYYVGRKPKVEQ LSNMIVRSCKCS | 117 |

TABLE 8-continued Non-human proteins

| Protein | Species | Sequence | SEQ ID NO |
|---|---|---|---|
| proTGF-β1 C4S (LAP) | Mouse | LSTSKTIDMELVKRKRIEAIRGQILSKLRLASPPSQGEVPP GPLPEAVLALYNSTRDRVAGESADPEPEPEADYYAKEV TRVLMVDRNNAIYEKTKDISHSIYMFFNTSDIREAVPEPP LLSRAELRLQRLKSSVEQHVELYQKYSNNSWRYLGNRL LTPTDTPEWLSFDVTGVVRQWLNQGDGIQGFRFSAHCS CDSKDNKLHVEINGISPKRRGDLGTIHDMNRPFLLLMAT PLERAQHLHSSRHRR | 118 |
| proTGF-β1 C4S (LAP) | Cyno | LSTSKTIDMELVKRKRIEAIRGQILSKLRLASPPSQGEVPP GPLPEAVLALYNSTRDRVAGESAEPEPEPEADYYAKEVT RVLMVETHNEIYDKFQSTHSIYMFFNTSELREAVPEPV LLSRAELRLLRLKLKVEQHVELYQKYSNNSWRYLSNRL LAPSDSPEWLSFDVTGVVRQWLSRGGEIEGFRLSAHCSC DSKDNTLQVDINGFTTGRRGDLATIHGMNRPFLLLMAT PLERAQHLQSSRHRR | 119 |
| proTGF-β1 C4S D2G | Mouse | LSTSKTIDMELVKRKRIEAIRGQILSKLRLASPPSQGEVPP GPLPEAVLALYNSTRDRVAGESADPEPEPEADYYAKEV TRVLMVDRNNAIYEKTKDISHSIYMFFNTSDIREAVPEPP LLSRAELRLQRLKSSVEQHVELYQKYSNNSWRYLGNRL LTPTDTPEWLSFDVTGVVRQWLNQGDGIQGFRFSAHCS CDSKDNKLHVEINGISPKRRGDLGTIHDMNRPFLLLMAT PLERAQHLHSSRHGALDTNYCFSSTEKNCCVRQLYIDFR KDLGWKWIHEPKGYHANFCLGPCPYIWSLDTQYSKVLA LYNQHNPGASASPCCVPQALEPLPIVYYVGRKPKVEQLS NMIVRSCKCS | 120 |
| proTGF-β1 C4S | Mouse | LSTSKTIDMELVKRKRIEAIRGQILSKLRLASPPSQGEVPP GPLPEAVLALYNSTRDRVAGESADPEPEPEADYYAKEV TRVLMVDRNNAIYEKTKDISHSIYMFFNTSDIREAVPEPP LLSRAELRLQRLKSSVEQHVELYQKYSNNSWRYLGNRL LTPTDTPEWLSFDVTGVVRQWLNQGDGIQGFRFSAHCS CDSKDNKLHVEINGISPKRRGDLGTIHDMNRPFLLLMAT PLERAQHLHSSRHRRALDTNYCFSSTEKNCCVRQLYIDF RKDLGWKWIHEPKGYHANFCLGPCPYIWSLDTQYSKVL ALYNQHNPGASASPCCVPQALEPLPIVYYVGRKPKVEQ LSNMIVRSCKCS | 121 |
| proTGF-β1 C4S | Cyno | LSTSKTIDMELVKRKRIEAIRGQILSKLRLASPPSQGEVPP GPLPEAVLALYNSTRDRVAGESAEPEPEPEADYYAKEVT RVLMVETHNEIYDKFQSTHSIYMFFNTSELREAVPEPV LLSRAELRLLRLKLKVEQHVELYQKYSNNSWRYLSNRL LAPSDSPEWLSFDVTGVVRQWLSRGGEIEGFRLSAHCSC DSKDNTLQVDINGFTTGRRGDLATIHGMNRPFLLLMAT PLERAQHLQSSRHRRALDTNYCFSSTEKNCCVRQLYIDF RKDLGWKWIHEPKGYHANFCLGPCPYIWSLDTQYSKVL ALYNQHNPGASAAPCCVPQALEPLPIVYYVGRKPKVEQ LSNMIVRSCKCS | 122 |
| proTGF-β1 C4S D2G | Cyno | LSTSKTIDMELVKRKRIEAIRGQILSKLRLASPPSQGEVPP GPLPEAVLALYNSTRDRVAGESAEPEPEPEADYYAKEVT RVLMVETHNEIYDKFQSTHSIYMFFNTSELREAVPEPV LLSRAELRLLRLKLKVEQHVELYQKYSNNSWRYLSNRL LAPSDSPEWLSFDVTGVVRQWLSRGGEIEGFRLSAHCSC DSKDNTLQVDINGFTTGRRGDLATIHGMNRPFLLLMAT PLERAQHLQSSRHGALDTNYCFSSTEKNCCVRQLYIDFR KDLGWKWIHEPKGYHANFCLGPCPYIWSLDTQYSKVLA LYNQHNPGASAAPCCVPQALEPLPIVYYVGRKPKVEQL SNMIVRSCKCS | 123 |
| LRRC32 | Cyno | MSPQILLLLALLTLGLAAQHQDKVACKMVDKKVSCQG LGLLQVPLVLPPDTETLDLSGNQLRSILASPLGFYTALRH LDLSTNEINFLQPGAFQALTHLEHLSLAHNRLAMATALS AGGLGPLPRVTSLDLSGNSLYSGLLERLLGEAPSLHTLSL AENSLTRLTRHTFRDMPALEQLDLHSNVLMDIEDGAFE GLPHLTHLNLSRNSLTCISDFSLQQLRVLDLSCNSIEAFQ TASQPQAEFQLTWLDLRENKLLHFPDLAALPRLIYLNLS NNLIRLPTGPPQDSKGIHAPSEGWSALPLSTPNGNVSARP LSQLLNLDLSYNEIELIPDSFLEHLTSLCFLNLSRNCLRTF EARRSGSLPCLMLLDLSHNALETLELGARALGSLRTLLL QGNALRDLPPYTFANLASLQRLNLQGNRVSPCGGPNEP GPASCVAFSGIASLRSLSLVDNEIELLRAGAFLHTPLTEL DLSSNPGLEVATGALTGLEASLEVLALQGNGLTVLQVD | 124 |

TABLE 8-continued

Non-human proteins

| Protein | Species | Sequence | SEQ ID NO |
|---|---|---|---|
| | | LPCFICLKRLNLAENRLSHLPAWTQAVSLEVLDLRNNSF SSLLPGSAMGGLETSLRRLYLQGNPLSCCGNGWLAAQLH QGRVDVDATQDLICRFSSQEEVSLSHVRPEDCEKGGLK NINLIIILTFILVSAILLTTLATCCCVRRQKFNQQYKA | |
| proGDF-8 | Mouse | NEGSEREENVEKEGLCNACAWRQNTRYSRIEAIKIQILS KLRLETAPNISKDAIRQLLPRAPPLRELIDQYDVQRDDSS DGSLEDDDYHATTETIITMPTESDFLMQADGKPKCCFFK FSSKIQYNKVVKAQLWIYLRPVKTPTTVFVQILRLIKPM KDGTRYTGIRSLKLDMSPGTGIWQSIDVKTVLQNWLKQ PESNLGIEIKALDENGHDLAVTFPGPGEDGLNPFLEVKV TDTPKRSRRDFGLDCDEHSTESRCCRYPLTVDFEAFGW DWIIAPKRYKANYCSGECEFVFLQKYPHTHLVHQANPR GSAGPCCTPTKMSPINMLYFNGKEQIIYGKIPAMVVDRC GCS | 125 |
| proGDF-8 AxxA | Mouse | NEGSEREENVEKEGLCNACAWRQNTRYSRIEAIKIQILS KLRLETAPNISKDAIRQLLPRAPPLRELIDQYDVQRDDSS DGSLEDDDYHATTETIITMPTESDFLMQADGKPKCCFFK FSSKIQYNKVVKAQLWIYLRPVKTPTTVFVQILRLIKPM KDGTRYTGIRSLKLDMSPGTGIWQSIDVKTVLQNWLKQ PESNLGIEIKALDENGHDLAVTFPGPGEDGLNPFLEVKV TDTPKASRADFGLDCDEHSTESRCCRYPLTVDFEAFGW DWIIAPKRYKANYCSGECEFVFLQKYPHTHLVHQANPR GSAGPCCTPTKMSPINMLYFNGKEQIIYGKIPAMVVDRC GCS | 126 |
| proGDF-8 D76A | Mouse | NEGSEREENVEKEGLCNACAWRQNTRYSRIEAIKIQILS KLRLETAPNISKDAIRQLLPRAPPLRELIDQYDVQRADSS DGSLEDDDYHATTETIITMPTESDFLMQADGKPKCCFFK FSSKIQYNKVVKAQLWIYLRPVKTPTTVFVQILRLIKPM KDGTRYTGIRSLKLDMSPGTGIWQSIDVKTVLQNWLKQ PESNLGIEIKALDENGHDLAVTFPGPGEDGLNPFLEVKV TDTPKRSRRDFGLDCDEHSTESRCCRYPLTVDFEAFGW DWIIAPKRYKANYCSGECEFVFLQKYPHTHLVHQANPR GSAGPCCTPTKMSPINMLYFNGKEQIIYGKIPAMVVDRC GCS | 127 |
| proGDF-8 AxxA D76A | Mouse | NEGSEREENVEKEGLCNACAWRQNTRYSRIEAIKIQILS KLRLETAPNISKDAIRQLLPRAPPLRELIDQYDVQRADSS DGSLEDDDYHATTETIITMPTESDFLMQADGKPKCCFFK FSSKIQYNKVVKAQLWIYLRPVKTPTTVFVQILRLIKPM KDGTRYTGIRSLKLDMSPGTGIWQSIDVKTVLQNWLKQ PESNLGIEIKALDENGHDLAVTFPGPGEDGLNPFLEVKV TDTPKASRADFGLDCDEHSTESRCCRYPLTVDFEAFGW DWIIAPKRYKANYCSGECEFVFLQKYPHTHLVHQANPR GSAGPCCTPTKMSPINMLYFNGKEQIIYGKIPAMVVDRC GCS | 128 |
| GDF-8 prodomain | Mouse | NEGSEREENVEKEGLCNACAWRQNTRYSRIEAIKIQILS KLRLETAPNISKDAIRQLLPRAPPLRELIDQYDVQRDDSS DGSLEDDDYHATTETIITMPTESDFLMQADGKPKCCFFK FSSKIQYNKVVKAQLWIYLRPVKTPTTVFVQILRLIKPM KDGTRYTGIRSLKLDMSPGTGIWQSIDVKTVLQNWLKQ PESNLGIEIKALDENGHDLAVTFPGPGEDGLNPFLEVKV TDTPKRSRR | 129 |
| GDF-8 prodomain D76A | Mouse | NEGSEREENVEKEGLCNACAWRQNTRYSRIEAIKIQILS KLRLETAPNISKDAIRQLLPRAPPLRELIDQYDVQRADSS DGSLEDDDYHATTETIITMPTESDFLMQADGKPKCCFFK FSSKIQYNKVVKAQLWIYLRPVKTPTTVFVQILRLIKPM KDGTRYTGIRSLKLDMSPGTGIWQSIDVKTVLQNWLKQ PESNLGIEIKALDENGHDLAVTFPGPGEDGLNPFLEVKV TDTPKRSRR | 130 |
| proGDF-8 | Cyno | NENSEQKENVEKEGLCNACTWRQNTKSSRIEAIKIQILSK LRLETAPNISKDAIRQLLPKAPPLRELIDQYDVQRDDSSD GSLEDDDYHATTETIIITMPTESDFLMQVDGKPKCCFFKF SSKIQYNKVVKAQLWIYLRPVETPTTVFVQILRLIKPMK DGTRYTGIRSLKLDMNPGTGIWQSIDVKTVLQNWLKQP ESNLGIEIKALDENGHDLAVTFPGPGEDGLNPFLEVKVT DTPKRSRRDFGLDCDEHSTESRCCRYPLTVDFEAFGWD | 131 |

TABLE 8-continued

Non-human proteins

| Protein | Species | Sequence | SEQ ID NO |
|---|---|---|---|
| | | WIIAPKRYKANYCSGECEFVFLQKYPHTHLVHQANPRG SAGPCCTPTKMSPINMLYFNGKEQIIYGKIPAMVVDRCG CS | |
| proGDF-8 AxxA | Cyno | NENSEQKENVEKEGLCNACTWRQNTKSSRIEAIKIQILSK LRLETAPNISKDAIRQLLPKAPPLRELIDQYDVQRDDSSD GSLEDDDYHATTETIITMPTESDFLMQVDGKPKCCFFKF SSKIQYNKVVKAQLWIYLRPVETPTTVFVQILRLIKPMK DGTRYTGIRSLKLDMNPGTGIWQSIDVKTVLQNWLKQP ESNLGIEIKALDENGHDLAVTFPGPGEDGLNPFLEVKVT DTPKASRADFGLDCDEHSTESRCCRYPLTVDFEAFGWD WIIAPKRYKANYCSGECEFVFLQKYPHTHLVHQANPRG SAGPCCTPTKMSPINMLYFNGKEQIIYGKIPAMVVDRCG CS | 132 |
| proGDF-8 D76A | Cyno | NENSEQKENVEKEGLCNACTWRQNTKSSRIEAIKIQILSK LRLETAPNISKDAIRQLLPKAPPLRELIDQYDVQRADSSD GSLEDDDYHATTETIITMPTESDFLMQVDGKPKCCFFKF SSKIQYNKVVKAQLWIYLRPVETPTTVFVQILRLIKPMK DGTRYTGIRSLKLDMNPGTGIWQSIDVKTVLQNWLKQP ESNLGIEIKALDENGHDLAVTFPGPGEDGLNPFLEVKVT DTPKRSRRDFGLDCDEHSTESRCCRYPLTVDFEAFGWD WIIAPKRYKANYCSGECEFVFLQKYPHTHLVHQANPRG SAGPCCTPTKMSPINMLYFNGKEQIIYGKIPAMVVDRCG CS | 133 |
| proGDF-8 AxxA D76A | Cyno | NENSEQKENVEKEGLCNACTWRQNTKSSRIEAIKIQILSK LRLETAPNISKDAIRQLLPKAPPLRELIDQYDVQRADSSD GSLEDDDYHATTETIITMPTESDFLMQVDGKPKCCFFKF SSKIQYNKVVKAQLWIYLRPVETPTTVFVQILRLIKPMK DGTRYTGIRSLKLDMNPGTGIWQSIDVKTVLQNWLKQP ESNLGIEIKALDENGHDLAVTFPGPGEDGLNPFLEVKVT DTPKASRADFGLDCDEHSTESRCCRYPLTVDFEAFGWD WIIAPKRYKANYCSGECEFVFLQKYPHTHLVHQANPRG SAGPCCTPTKMSPINMLYFNGKEQIIYGKIPAMVVDRCG CS | 134 |
| GDF-8 prodomain | Cyno | NENSEQKENVEKEGLCNACTWRQNTKSSRIEAIKIQILSK LRLETAPNISKDAIRQLLPKAPPLRELIDQYDVQRDDSSD GSLEDDDYHATTETIITMPTESDFLMQVDGKPKCCFFKF SSKIQYNKVVKAQLWIYLRPVETPTTVFVQILRLIKPMK DGTRYTGIRSLKLDMNPGTGIWQSIDVKTVLQNWLKQP ESNLGIEIKALDENGHDLAVTFPGPGEDGLNPFLEVKVT DTPKRSRR | 135 |
| GDF-8 prodomain D76A | Cyno | NENSEQKENVEKEGLCNACTWRQNTKSSRIEAIKIQILSK LRLETAPNISKDAIRQLLPKAPPLRELIDQYDVQRADSSD GSLEDDDYHATTETIITMPTESDFLMQVDGKPKCCFFKF SSKIQYNKVVKAQLWIYLRPVETPTTVFVQILRLIKPMK DGTRYTGIRSLKLDMNPGTGIWQSIDVKTVLQNWLKQP ESNLGIEIKALDENGHDLAVTFPGPGEDGLNPFLEVKVT DTPKRSRR | 136 |
| proGDF-11 | Mouse | AEGPAAAAAAAAAAGVGGERSSRPAPSAPPEPDGCPV CVWRQHSRELRLESIKSQILSKLRLKEAPNISREVVKQLL PKAPPLQQILDLHDFQGDALQPEDFLEEDEYHATTETVIS MAQETDPAVQTDGSPLCCHFHFSPKVMFTKVLKAQLW VYLRPVPRPATVYLQILRLKPLTGEGTAGGGGGRRHIR IRSLKIELHSRSGHWQSIDFKQVLHSWFRQPQSNWGIEIN AFDPSGTDLAVTSLGPGAEGLHPFMELRVLENTKRSRRN LGLDCDEHSSESRCCRYPLTVDFEAFGWDWIIAPKRYKA NYCSGQCEYMFMQKYPHTHLVQQANPRGSAGPCCTPT KMSPINMLYFNDKQQIIYGKIPGMVVDRCGCS | 137 |
| proGDF-11 AxxA | Mouse | AEGPAAAAAAAAAAGVGGERSSRPAPSAPPEPDGCPV CVWRQHSRELRLESIKSQILSKLRLKEAPNISREVVKQLL PKAPPLQQILDLHDFQGDALQPEDFLEEDEYHATTETVIS MAQETDPAVQTDGSPLCCHFHFSPKVMFTKVLKAQLW VYLRPVPRPATVYLQILRLKPLTGEGTAGGGGGRRHIR IRSLKIELHSRSGHWQSIDFKQVLHSWFRQPQSNWGIEIN AFDPSGTDLAVTSLGPGAEGLHPFMELRVLENTKASRA NLGLDCDEHSSESRCCRYPLTVDFEAFGWDWIIAPKRYK ANYCSGQCEYMFMQKYPHTHLVQQANPRGSAGPCCTP TKMSPINMLYFNDKQQIIYGKIPGMVVDRCGCS | 138 |

TABLE 8-continued

Non-human proteins

| Protein | Species | Sequence | SEQ ID NO |
|---|---|---|---|
| proGDF-11 AxxA D96A | Mouse | AEGPAAAAAAAAAAAGVGGERSSRPAPSAPPEPDGCPV CVWRQHSRELRLESIKSQILSKLRLKEAPNISREVVKQLL PKAPPLQQILDLHDFQGAALQPEDFLEEDEYHATTETVIS MAQETDPAVQTDGSPLCCHFHFSPKVMFTKVLKAQLW VYLRPVPRPATVYLQILRLKPLTGEGTAGGGGGGRRHIR IRSLKIELHSRSGHWQSIDFKQVLHSWFRQPQSNWGIEIN AFDPSGTDLAVTSLGPGAEGLHPFMELRVLENTKASRA NLGLDCDEHSSESRCCRYPLTVDFEAFGWDWIIAPKRYK ANYCSGQCEYMFMQKYPHTHLVQQANPRGSAGPCCTP TKMSPINMLYFNDKQQIIYGKIPGMVVDRCGCS | 139 |
| proGDF-11 D96A | Mouse | AEGPAAAAAAAAAAAGVGGERSSRPAPSAPPEPDGCPV CVWRQHSRELRLESIKSQILSKLRLKEAPNISREVVKQLL PKAPPLQQILDLHDFQGDALQPEDFLEEDEYHATTETVIS MAQETDPAVQTDGSPLCCHFHFSPKVMFTKVLKAQLW VYLRPVPRPATVYLQILRLKPLTGEGTAGGGGGGRRHIR IRSLKIELHSRSGHWQSIDFKQVLHSWFRQPQSNWGIEIN AFDPSGTDLAVTSLGPGAEGLHPFMELRVLENTKRSRRN LGLDCDEHSSESRCCRYPLTVDFEAFGWDWIIAPKRYKA NYCSGQCEYMFMQKYPHTHLVQQANPRGSAGPCCTPT KMSPINMLYFNDKQQIIYGKIPGMVVDRCGCS | 140 |
| GDF-11 prodomain | Mouse | AEGPAAAAAAAAAAAGVGGERSSRPAPSAPPEPDGCPV CVWRQHSRELRLESIKSQILSKLRLKEAPNISREVVKQLL PKAPPLQQILDLHDFQGDALQPEDFLEEDEYHATTETVIS MAQETDPAVQTDGSPLCCHFHFSPKVMFTKVLKAQLW VYLRPVPRPATVYLQILRLKPLTGEGTAGGGGGGRRHIR IRSLKIELHSRSGHWQSIDFKQVLHSWFRQPQSNWGIEIN AFDPSGTDLAVTSLGPGAEGLHPFMELRVLENTKRSRR | 141 |
| GDF-11 prodomain D96A | Mouse | AEGPAAAAAAAAAAAGVGGERSSRPAPSAPPEPDGCPV CVWRQHSRELRLESIKSQILSKLRLKEAPNISREVVKQLL PKAPPLQQILDLHDFQGAALQPEDFLEEDEYHATTETVIS MAQETDPAVQTDGSPLCCHFHFSPKVMFTKVLKAQLW VYLRPVPRPATVYLQILRLKPLTGEGTAGGGGGGRRHIR IRSLKIELHSRSGHWQSIDFKQVLHSWFRQPQSNWGIEIN AFDPSGTDLAVTSLGPGAEGLHPFMELRVLENTKRSRR | 142 |
| LTBP3 | CYNO | MPGPRGAPGGLAPEMRGAGAAGLLALLLLLGLGGRVE GGPAGERGAGGGGALARERFKVVFAPVICKRTCLKGQC RDSCQQGSNMTLIGENGHSTDTLTGSSGFRVVVCPLPCM NGGGQCSSRNQCLCPPDFTGRFCQVPAGGAGGGTGGSGP GLSRAGALSTGALPPLAPEGDSVASKHAIYAVQVIADPP GPGEGPPAQHAAFLVPLGPGQISAEVQAPPPVVNVRVH HPPEASVQVHRIESSNAEGAAPSQHLLPHPKPSHPRPPTQ KPLGRCFQDTLPKQPCGSNPLPGLTKQEDCCGSIGTAWG QSKCHKCPQLQYTGVQKPGPVRGEVGADCPQGYKRLN STHCQDINECAMPGVCRHGDCLNNPGSYRCVCPPGHSL GPSRTQCIADKPEEKSLCFRLVSPEHQCQHPLTTRLTRQL CCCSVGKAWGARCQRCPADGTAAFKEICPAGKGYHILT SHQTLTIQGESDFSLFLHPDGPPKPQQLPESPSQAPPPEDT EEERGVTTDSPVSEERSVQQSHPTATTSPARPYPELISRPS PPTMRWFLPDLPPSRSAVEIAPTQVTETDECRLNQNICG HGECVPGPPDYSCHCNPGYRSHPQHRYCVDVNECEAEP CGPGRGICMNTGGSYNCHCNRGYRLHVGAGGRSCVDL NECAKPHLCGDGGFCINFPGHYKCNCYPGYRLKASRPP VCEDIDECRDPSSCPDGKCENKPGSFKCIACQPGYRSQG GGACRDVNECAEGSPCSPGWCENLPGSFRCTCAQGYAP APDGRSCVDVDECEAGDVCDNGICTNTPGSFQCQCLSG YHLSRDRSHCEDIDECDFPAACIGGDCINTNGSYRCLCP QGHRLVGGRKCQDIDIDECTQDPGLCLPHGACKNLQGSYV CVCDEGFTPTQDQHGCEEVEQPHHKKECYLNFDDTVFC DSVLATNVTQQECCCSLGAGWGDHCEIYPCPVYSSAEF HSLCPDGKGYTQDNNIVNYGIPAHRDIDECMLFGAEICK EGKCVNTQPGYECYCKQGFYYDGNLLECVDVDECLDE SNCRNGVCENTRGGYRCACTPPAEYSPAQRQCLSPEEM DVDECQDPAACRPGRCVNLPGSYRCECRPPWVPGPSGR DCQLPESPAERAPERRDVCWSQRGEDGMCAGPQAGPA LTFDDCCCRQGRGWGAQCRPCPPPRGAGSQCPTSQSESN SFWDTSPLLLGKPRRDEDSSEEDSDECRCVSGRCVPRPG GAVCECPGGFQLDASRARCVDIDECRELNQRGLLCKSE RCVNTSGSFRCVCKAGFARSRPHGACVPQRRR | 143 |

TABLE 8-continued

Non-human proteins

| Protein | Species | Sequence | SEQ ID NO |
|---|---|---|---|
| LTBP3 | Mouse | MPGPRGAAHGLAPAMHQAGALGLLALLLLALLGPGGG AEGGPAGERGTGGGGALARERFKVVFAPVICKRTCLKG QCRDSCQQGSNMTLIGENGHSTDTLTGSAFRVVVCPLPC MNGGQCSSRNQCLCPPDFTGRFCQVPAAGTGAGTGSSG PGLARTGAMSTGPLPPLAPEGESVASKHAIYAVQVIADP PGPGEGPPAQHAAFLVPLGPGQISAEVQAPPPVVNVRVH HPPEASVQVHRIEGPNAEGPASSQHLLPHPKPPHPRPPTQ KPLGRCFQDTLPKQPCGSNPLPGLTKQEDCCGSIGTAWG QSKCHKCPQLQYTGVQKPVPVRGEVGADCPQGYKRLN STHCQDINECAMPGNVCHGDCLNNPGSYRCVCPPGHSL GPLAAQCIADKPEEKSLCFRLVSTEHQCQHPLTTRLTRQ LCCCSVGKAWGARCQRCPADGTAAFKEICPGKGYHILT SHQTLTIQGESDFSLFLHPDGPPKPQQLPESPSRAPPLEDT EEERGVTMDPPVSEERSVQQSHPTTTTSPPRPYPELISRPS PPTFHRFLPDLPPSRSAVEIAPTQVTETDECRLNQNICGH GQCVPGPSDYSCHCNAGYRSHPQHRYCVDVNECEAEPC GPGKGICMNTGGSYNCHCNRGYRLHVGAGGRSCVDLN ECAKPHLCGDGGFCINFPGHYKCNCYPGYRLKASRPPIC EDIDECRDPSTCPDGKCENKPGSFKCIACQPGYRSQGGG ACRDVNECSEGTPCSPGWCENLPGSYRCTCAQYEPAQD GLSCIDVDECEAGKVCQDGICTNTPGSFQCQCLSGYHLS RDRSRCEDIDECDFPAACIGGDCINTNGSYRCLCPLGHR LVGGRKCKKDIDECSQDPGLCLPHACENLQGSYVCVCD EGFTLTQDQHGCEEVEQPHHKKECYLNFDDTVFCDSVL ATNVTQQECCCSLGAGWGDHCEIYPCPVYSSAEFHSLV PDGKRLHSGQQHCELCIPAHRDIDECILFGAEICKEGKCV NTQPGYECYCKQGFYYDGNLLECVDVDECLDESNCRN GVCENTRGGYRCACTPPAEYSPAQAQCLIPERWSTPQR DVKCAGASEERTACVWGPWAGPALTFDDCCCRQPRLG TQCRPCPPRGTGSQCPTSQSESNSFWDTSPLLLGKSPRDE DSSEEDSDECRCVSGRCVPRPGGAVCECPGGFQLDASR ARCVDIDECRELNQRGLLCKSERCVNTSGSFRCVCKAGF TRSRPHGPACLSAAADDAAIAHTSVIDHRGYFH | 144 |
| LTBP1 | Cyno | MAGAWLRWGLLLWAGLLASSAHGRLRRITYVVHPGPG LAAGALPLSGPPRSRTFNVALNARYSRSSAAAGAPSRAS PGVPSERTRRTSKPGGAALQGLRPPPPPPPEPARPAAPGG QLHPKPGGHPAAAPFAKQGRQVVRSKVPQETQSSGGSR LQVHQKQQLQGVNVCGGRCCHGWSKAPGSQRCTKRSC VPPCQNGGMCLRPQLCVCKPGTKGKACETIAAQDTSSP VFGGQSPGAASSWGPPEQAAKHTSSKKADTLPRVSPVA QMTLTLKPKPSVGLPQQIHSQVTPLSSQSVMIHHSQTQE YVLKPKYFPAQKGISGEQSTEGSFPLRYVQDQVAAPFQL SNHTGRIKVVFTPSICKVTCTKGSCQNSCEKGNTTTLISE NGHAADTLTATNFRVVLCHLPCMNGGQCSSRDKCQCPP NFTGKLCQIPVHGASVPKLYQHSQQPGKALGTHVIHSTH TLPLTVTSQQGVKVKFPPNIVNIHVKHPPEASVQIHQVSR IDGPTGQKTKEAQPGQSQVSYQGLPVQKTQTIHSTYSHQ QVIPHVYPVAAKTQLGRCFQETIGSQCGKALPGLSKQED CCGTVGTSWGFNKCQKCPKKPSYHGYNQMMECLPGYK RVNNTFCQDINECQLQGVCPNGECLNTMGSYRCTCKIG FGPDPTFSSCVPDPPVISEEKGPCYRLVSSGRQCMHPLSV HLTKQLCCCSVGKAWGPHCEKCPLPGTAAFKEICPGGM GYTVSGVHRRRPIHHHVGKGPVFVKPKNTQPVAKSTHP PPLPAKEEPVEALTFSREHGPGVAEPEVATAPPEKEIPSL DQEKTKLEPGQPQLSPGISTIHLHPQFPVVIEKTSPPVPVE VAPEASTSSASQVIAPTQVTEINECTVNPDICGAGHCINL PVRYTCICYEGYKFSEQQRKCVDIDECTQVQHLCSQGRC ENTEGSFLCICPAGFMASEEGTNCIDVDECLRPDVCGEG HCVNTVGAFRCEYCDSGYRMTQRGRCEDIDECLNPSTC PDEQCVNSPGSYQCVPCTEGFRGWNGQCLDVDECLEPN VCTNGDCSNLEGSYMCSCHKGYTRTPDHKHCKDIDECQ QGNLCVNGQCKNTEGSFRCTCGQGYQLSAAKDQCEDID ECQHHHLCAHGQCRNTEGSFQCVCDQGYRASGLGDHC EDINECLEDKSVCQRGDCINTAGSYDCTCPDGFQLDDN KTCQDINECEHPGLCGPQGECLNTEGSFHCVCQQGFSIS ADGRTCEDIDECVNNTVCDSHGFCDNTAGSFRCLCYQG FQAPQDGQGCVDVNECELLSGVCGEAFCENVEGSFLCV CADENQEYSPMTGQCRSRTSTDLDVEQPKEEKKECYYN LNDASLCDNVLAPNVTKQECCCTSGAGWGDNCEIFPCP VLGTAEFTEMCPKGKGFVPAGESSSEAGGENYKDADEC LLFGQEICKNGFCLNTRPGYECYCKQGTYYDPVKLQCF DMDECQDPSSCIDGQCVNTEGSYNCFCTHPMVLDASEK RCIRPAESNEQIEETDVYQDLCWEHLSDEYVCSRPLVGK | 145 |

TABLE 8-continued

Non-human proteins

| Protein | Species | Sequence | SEQ ID NO |
|---|---|---|---|
| | | QTTYTECCCLYGEAWGMQCALCPMKDSDDYAQLCNIP VTGRRQPYGRDALVDFSEQYAPEADPYFIQDRFLNSFEE LQAEEECGILNGCENGRCVRVQEGYTCDCFDGYHLDTAK MTCVDVNECDELNNRMSLCKNAKCINTEGSYKCLCLPG YVPSDKPNYCTPLNTALNLEKDSDLE | |
| LTBP1S | mouse | NHTGRIKVVFTPSICKVTCTKGNCQNSCQKGNTTTLISE NGHAADTLTATNFRVVICHLPCMNGGQCSSRDKCQCPP NFTGKLCQIPVLGASMPKLYQHAQQQGKALGSHVIHST HTLPLTMTSQQGVKVKFPPNIVNIHVKHPPEASVQIHQV SRIDSPGGQKVKEAQPGQSQVSYQGLPVQKTQTVHSTY SHQQLIPHVYPVAAKTQLGRCFQETIGSQCGKALPGLSK QEDCCGTVGTSWGFNKCQKCPKKQSYHGYTQMMECL QGYKRVNNTFCQDINECQLQGVCPNGECLNTMGSYRCS CKMGFGPDPTFSSCVPDPPVISEEKGPCYRLVSPGRHCM HPLSVHLTKQICCCSVGKAWGPHCEKCPLPGTAAFKEIC PGGMGYTVSGVHRRRPIHQHIGKEAVYVKPKNTQPVAK STHPPPLPAKEEPVEALTSSWEHGPRGAEPEVVTAPPEK EIPSLDQEKTRLEPGQPQLSPGVSTIHLHPQFPVVVEKTSP PVPVEVAPEASTSSASQVIAPTQVTEINECTVNPDICGAG HCINLPVRYTCICYEGYKFSEQLRKCVDIDECAQVRHLC SQGRCENTEGSFLCVCPAGFMASEEGTNCIDVDECLRPD MCRDGRCINTAGAFRCEYCDSGYRMSRRGYCEDIDECL KPSTCPEEQCVNTPGSYQCVPCTEGFRGWNGQCLDVDE CLQPKVCTNGSCTNLEGSYMCSCHRGYSPTPDHRHCQD IDECQQGNLCMNGQCRNTDGSFRCTCGQGYQLSAAKD QCEDIDECEHHHLCSHGQCRNTEGSFQCVCNQGYRASV LGDHCEDINECLEDSSVCQGGDCINTAGSYDCTCPDGFQ LNDNKGCQDINECAQPGLCGSHGECLNTQGSFHCVCEQ GFSISADGRTCEDIDECVNNTVCDSHGFCDNTAGSFRCL CYQGFQAPQDGQGCVDVNECELLSGVCGEAFCENVEGS FLCVCADENQEYSPMTGQCRSRVTEDSGVDRQPREEKK ECYYNLNDASLCDNVLAPNVTKQECCCTSGAGWGDNC EIFPCPVQGTAEFTEMCPRGKGLVPAGESSYDTGGENYK DADECLLFGEEICKNGYCLNTQPGYECYCKQGTYYDPV KLQCFDMDECQDPNSCIDGQCVNTEGSYNCFCTHPMVL DASEKRCVQPTESNEQIEETDVYQDLCWEHLSEEYVCSR PLVGKQTTYTECCCLYGEAWGMQCALCPMKDSDDYA QLCNIPVTGRRRPYGRDALVDFSEQYGPETDPYFIQDRF LNSFEELQAEEECGILNGCENGRCVRVQEGYTCDCFDGY HLDMAKMTCVDVNECSELNNRMSLCKNAKCINTEGSY KCLCLPGYIPSDKPNYCTPLNSALNLDKESDLE | 146 |
| GARP | mouse | ISQRREQVPCRTVNKEALCHGLGLLQVPSVLSLDIQALY LSGNQLQSILVSPLGFYTALRHDLSDNQISFLQAGVFQA LPYLEHLNLAHNRLATGMALNSGGLGRLPLLVSLDLSG NSLHGNLVERLLGETPRLRTLSLAENSLTRLARHTFWG MPAVEQLDLHSNVLMDIEDGAFEALPHLTHLNLSRNSL TCISDFSLQQLQVLDLSCNSIEAFQTAPEPQAQFQLAWL DLRENKLLHFPDLAVFPRLIYLNVSNNLIQLPAGLPRGSE DLHAPSEGWSASPLSNPSRNASTHPLSQLLNLDLSYNEIE LVPASFLEHLTSLRFLNLSRNCLRSFEARQVDSLPCLVLL DLSHNVLEALELGTKVLGSLQTLLLQDNALQELPPYTFA SLASLQRLNLQGNQVSPCGGPAEPGPPGCVDFSGIPTLH VLNMAGNSMGMLRAGSFLHTPLTELDLSTNPGLDVATG ALVGLEASLEVLELQGNGLTVLRVDLPCFLRLKRLNLAE NQLSHLPAWTRAVSLEVLDLRNNSFSLLPGNAMGGLET SLRRLYLQGNPLSCCGNGWLAAQLHQGRVDVDATQDL ICRFGSQEELSLSLVRPEDCEKGGLKNVNLILLLSFTLVS AIVLTTLATICFLRRQKLSQQYKA | 147 |
| sGARP | mouse | ISQRREQVPCRTVNKEALCHGLGLLQVPSVLSLDIQALY LSGNQLQSILVSPLGFYTALRHDLSDNQISFLQAGVFQA LPYLEHLNLAHNRLATGMALNSGGLGRLPLLVSLDLSG NSLHGNLVERLLGETPRLRTLSLAENSLTRLARHTFWG MPAVEQLDLHSNVLMDIEDGAFEALPHLTHLNLSRNSL TCISDFSLQQLQVLDLSCNSIEAFQTAPEPQAQFQLAWL DLRENKLLHFPDLAVFPRLIYLNVSNNLIQLPAGLPRGSE DLHAPSEGWSASPLSNPSRNASTHPLSQLLNLDLSYNEIE LVPASFLEHLTSLRFLNLSRNCLRSFEARQVDSLPCLVLL DLSHNVLEALELGTKVLGSLQTLLLQDNALQELPPYTFA SLASLQRLNLQGNQVSPCGGPAEPGPPGCVDFSGIPTLH VLNMAGNSMGMLRAGSFLHTPLTELDLSTNPGLDVATG ALVGLEASLEVLELQGNGLTVLRVDLPCFLRLKRLNLAE | 148 |

TABLE 8-continued

Non-human proteins

| Protein | Species | Sequence | SEQ ID NO |
|---|---|---|---|
| | | NQLSHLPAWTRAVSLEVLDLRNNSFSLLPGNAMGGLET SLRRLYLQGNPLSCCGNGWLAAQLHQGRVDVDATQDL ICRFGSQEELSLSLVRPEDCEKGGLKNVN | |
| LRRC33 | mouse | WRSGPGTATAASQGGCKVVDGVADCRGLNLASVPSSLP PHSRMLILDANPLKDLWNHSLQAYPRLENLSLHSCHLD RISHYAFREQGHLRNLVLADNRLSENYKESAAALHTLL GLRRLDLSGNSLTEDMAALMLQNLSSLEVVSLARNTLM RLDDSIFEGLEHLVELDLQRNYIFEIEGGAFDGLTELRRL NLAYNNLPCIVDFSLTQLRFLNVSYNILEWFLAAREEVA FELEILDLSHNQLLFFPLLPQCGKLHTLLLQDNNMGFYR ELYNTSSPQEMVAQFLLVDGNVTNITTVNLWEEFSSSDL SALRFLDMSQNQFRHLPDGFLKKTPSLSHLNLNQNCLK MLHIREHEPPGALTELDLSHNQLAELHLAPGLTGSLRNL RVFNLSSNQLLGVPTGLFDNASSITTIDMSHNQISLCPQM VPVDWEGPPSCVDFRNMGSLRSLSLDGCGLKALQDCPF QGTSLTHLDLSSNWGVLNGSISPLWAVAPTLQVLSLRD VGLGSGAAEMDFSAFGNLRALDLSGNSLTSFPKFKGSLA LRTLDLRRNSLTALPQRVVSEQPLRGLQTIYLSQNPYDC CGVEGWGALQQHFKTVADLSMVTCNLSSKIVRVVELPE GLPQGCKWEQVDTGLFYLVLILPSCLTLLVACTVVFLTF KKPLLQVIKSRCHWSSIY | 149 |
| sLRRC33 | mouse | WRSGPGTATAASQGGCKVVDGVADCRGLNLASVPSSLP PHSRMLILDANPLKDLWNHSLQAYPRLENLSLHSCHLD RISHYAFREQGHLRNLVLADNRLSENYKESAAALHTLL GLRRLDLSGNSLTEDMAALMLQNLSSLEVVSLARNTLM RLDDSIFEGLEHLVELDLQRNYIFEIEGGAFDGLTELRRL NLAYNNLPCIVDFSLTQLRFLNVSYNILEWFLAAREEVA FELEILDLSHNQLLFFPLLPQCGKLHTLLLQDNNMGFYR ELYNTSSPQEMVAQFLLVDGNVTNITTVNLWEEFSSSDL SALRFLDMSQNQFRHLPDGFLKKTPSLSHLNLNQNCLK MLHIREHEPPGALTELDLSHNQLAELHLAPGLTGSLRNL RVFNLSSNQLLGVPTGLFDNASSITTIDMSHNQISLCPQM VPVDWEGPPSCVDFRNMGSLRSLSLDGCGLKALQDCPF QGTSLTHLDLSSNWGVLNGSISPLWAVAPTLQVLSLRD VGLGSGAAEMDFSAFGNLRALDLSGNSLTSFPKFKGSLA LRTLDLRRNSLTALPQRVVSEQPLRGLQTIYLSQNPYDC CGVEGWGALQQHFKTVADLSMVTCNLSSKIVRVVELPE GLPQGCKWEQVDTGL | 150 |
| LRRC33 | Cyno | WRDRSVTATAASQRGCKLVGGDTDCRGQSLASVPSSLP PHARTLILDANPLKALWNHSLQPYPLLESLSLHSCHLERI GRGAFQEQGHLRSLVLGDNCLSENYKETAAALHTLPGL QTLDLSGNSLTEDMAALMLQNLSSLQSVSLARNTIMRL DDSVFEGLERLRELDLQRNYIFEIEGGAFDGLTELRHLNL AYNNLPCIVDFGLTQLRSLNVSYNVLEWFLAAGGEAAF ELETLDLSHNQLLFFPLLPQYSKLHTLLLRDNNMGFYRD LYNTSSPREMVAQFLLVDGNVTNITTVNLWEEFSSSDLA DLRFLDMSQNQFQYLPDGFLRKMPSLSHLNLNQNCLMT LHIREHEPPGALTELDLSHNQLSELHLTPGLASCLGSLRL FNLSSNQLLGVPPGLFANARNITTLDMSHNQISLCPLPAA SDRVGPPSCVDFRNMASLRSLSLEGCGLGALPDCPFQGT SLTSLDLSSNWGVLNGSLAPLRDVAPMLQVLSLRNMGL HSNFMALDFSGFGNLRDLDLSGNCLTTFPRFGGSLALET LDLRRNSLTALPQKAVSEQLSRGLRTIYLSQNPYDCCGV DGWGALQQGQTVADWATVTCNLSSKIIRLAELPGGVPR DCKWERLDLGLLYLVLILPSCLTLLVACTLIVLTFKKPLL QVIKSRCHWSSVY | 151 |
| sLRRC33 | Cyno | WRDRSVTATAASQRGCKLVGGDTDCRGQSLASVPSSLP PHARTLILDANPLKALWNHSLQPYPLLESLSLHSCHLERI GRGAFQEQGHLRSLVLGDNCLSENYKETAAALHTLPGL QTLDLSGNSLTEDMAALMLQNLSSLQSVSLARNTIMRL DDSVFEGLERLRELDLQRNYIFEIEGGAFDGLTELRHLNL AYNNLPCIVDFGLTQLRSLNVSYNVLEWFLAAGGEAAF ELETLDLSHNQLLFFPLLPQYSKLHTLLLRDNNMGFYRD LYNTSSPREMVAQFLLVDGNVTNITTVNLWEEFSSSDLA DLRFLDMSQNQFQYLPDGFLRKMPSLSHLNLNQNCLMT LHIREHEPPGALTELDLSHNQLSELHLTPGLASCLGSLRL FNLSSNQLLGVPPGLFANARNITTLDMSHNQISLCPLPAA SDRVGPPSCVDFRNMASLRSLSLEGCGLGALPDCPFQGT SLTSLDLSSNWGVLNGSLAPLRDVAPMLQVLSLRNMGL HSNFMALDFSGFGNLRDLDLSGNCLTTFPRFGGSLALET | 152 |

TABLE 8-continued

Non-human proteins

| Protein | Species | Sequence | SEQ ID NO |
|---------|---------|----------|-----------|
| | | LDLRRNSLTALPQKAVSEQLSRGLRTIYLSQNPYDCCGV DGWGALQQGQTVADWATVTCNLSSKIIRLAELPGGVPR DCKWERLDLGL | |

In some embodiments, recombinant proteins may be combined and/or complexed with one or more additional recombinant components. Such components may include extracellular proteins known to associate with GPCs including, but not limited to LTBPs, fibrillins, perlecan, GASP1/2 proteins, follistatin, follistatin-related gene (FLRG), decorin and/or GARP (including, but not limited to recombinant forms of such proteins). Some recombinant GPCs of the present invention must be co-expressed with one or more of such extracellular proteins for proper expression and/or folding.

In some embodiments, complexed LTBPs may include, but are not limited to LTBP1, LTBP2, LTBP3 and/or LTBP4. Complexed LTBPs may comprise LTBP fragments and/or mutations. Some recombinant forms of LTBPs complexed with recombinant GPCs may comprise alternatively spliced variants of LTBPs. Some such variants of LTBP1 are shortened at the N-terminus, referred to herein as LTBP1S. Some recombinant proteins of the present invention may comprise LTBPs, fragments or mutants thereof comprising the amino acid sequences listed in Table 9.

TABLE 9

LTBP sequences

| Protein | Sequence | SEQ ID NO |
|---------|----------|-----------|
| LTBP1 1265-1443 | NECELLSGVCGEAFCENVEGSFLCVCADENQEYSPM TGQCRSRTSTDLDVDVDQPKEEKKECYYNLNDASLC DNVLAPNVTKQECCCTSGVGWGDNCEIFPCPVLGTA EFTEMCPKGKGFVPAGESSSEAGGENYKDADECLLF GQEICKNGFCLNTRPGYECYCKQGTYYDPVKLQCF | 153 |
| LTBP1 1265-1698 | NECELLSGVCGEAFCENVEGSFLCVCADENQEYSPM TGQCRSRTSTDLDVDVDQPKEEKKECYYNLNDASLC DNVLAPNVTKQECCCTSGVGWGDNCEIFPCPVLGTA EFTEMCPKGKGFVPAGESSSEAGGENYKDADECLLF GQEICKNGFCLNTRPGYECYCKQGTYYDPVKLQCFD MDECQDPSSCIDGQCVNTEGSYNCFCTHPMVLDASE KRCIRPAESNEQIEETDVYQDLCWEHLSDEYVCSRP LVGKQTTYTECCCLYGEAWGMQCALCPLKDSDDYAQ LCNIPVTGRRQPYGRDALVDFSEQYTPEADPYFIQD RFLNSFEELQAEECGILNGCENGRCVRVQEGYTCDC FDGYHLDTAKMTCVDVNECDELNNRMSLCKNAKCIN TDGSYKCLCLPGYVPSDKPNYCTPLNTALNLEKDSD LE | 154 |
| LTBP1 809-1698 | PSLDQEKTKLEPGQPQLSPGISTIHLHPQFPVVIEK TSPPVPVEVAPEASTSSASQVIAPTQVTEINECTVN PDICGAGHCINLPVRYTCICYEGYRFSEQQRKCVDI DECTQVQHLCSQGRCENTEGSFLCICPAGFMASEEG TNCIDVDECLRPDVCGEGHCVNTVGAFRCEYCDSGY RMTQRGRCEDIDECLNPSTCPDEQCVNSPGSYQCVP CTEGFRGWNGQCLDVDECLEPNVCANGDCSNLEGSY MCSCHKGYTRTPDHKHCRDIDECQQGNLCVNGQCKN TEGSFRCTCGQGYQLSAAKDQCEDIDECQHRHLCAH GQCRNTEGSFQCVCDQGYRASGLGDHCEDINECLED KSVCQRGDCINTAGSYDCTCPDGFQLDDNKTCQDIN ECEHPGLCGPQGECLNTEGSFHCVCQQGFSISADGR TCEDIDECVNNTVCDSHGFCDNTAGSFRCLCYQGFQ APQDGQGCVDVNECELLSGVCGEAFCENVEGSFLCV CADENQEYSPMTGQCRSRTSTDLDVDVDQPKEEKKE CYYNLNDASLCDNVLAPNVTKQECCCTSGVGWGDNC EIFPCPVLGTAEFTEMCPKGKGFVPAGESSSEAGGE NYKDADECLLFGQEICKNGFCLNTRPGYECYCKQGT YYDPVKLQCFDMDECQDPSSCIDGQCVNTEGSYNCF CTHPMVLDASEKRCIRPAESNEQIEETDVYQDLCWE HLSDEYVCSRPLVGKQTTYTECCCLYGEAWGMQCAL CPLKDSDDYAQLCNIPVTGRRQPYGRDALVDFSEQY TPEADPYFIQDRFLNSFEELQAEECGILNGCENGRC VRVQEGYTCDCFDGYHLDTAKMTCVDVNECDELNNR MSLCKNAKCINTDGSYKCLCLPGYVPSDKPNYCTPL NTALNLEKDSDLE | 155 |
| LTBP1S | NHTGRIKVVFTPSICKVTCTKGSCQNSCEKGNTTTL ISENGHAADTLTATNFRVVICHLPCMNGGQCSSRDK CQCPPNFTGKLCQIPVHGASVPKLYQHSQQPGKALG THVIHSTHTLPLTVTSQQGVKVKFPPNIVNIHVKHP PEASVQIHQVSRIDGPTGQKTKEAQPGQSQVSYQGL PVQKTQTIHSTYSHQQVIPHVYPVAAKTQLGRCFQE TIGSQCGKALPGLSKQEDCCGTVGTSWGFNKCQKCP KKPSYHGYNQMMECLPGYKRVNNTFCQDINECQLQG VCPNGECLNTMGSYRCTCKIGFGPDPTFSSCVPDPP VISEEKGPCYRLVSSGRQCMHPLSVHLTKQLCCCSV GKAWGPHCEKCPLPGTAAFKEICPGGMGYTVSGVHR RRPIHHHVGKGPVFVKPKNTQPVAKSTHPPPLPAKE EPVEALTFSREHGPGVAEPEVATAPPEKEIPSLDQE KTKLEPGQPQLSPGISTIHLHPQFPVVIEKTSPPVP VEVAPEASTSSASQVIAPTQVTEINECTVNPDICGA GHCINLPVRYTCICYEGYRFSEQQRKCVDIDECTQV QHLCSQGRCENTEGSFLCICPAGFMASEEGTNCIDV DECLRPDVCGEGHCVNTVGAFRCEYCDSGYRMTQRG RCEDIDECLNPSTCPDEQCVNSPGSYQCVPCTEGFR GWNGQCLDVDECLEPNVCANGDCSNLEGSYMCSCHK GYTRTPDHKHCRDIDECQQGNLCVNGQCKNTEGSFR CTCGQGYQLSAAKDQCEDIDECQHRHLCAHGQCRNT EGSFQCVCDQGYRASGLGDHCEDINECLEDKSVCQR GDCINTAGSYDCTCPDGFQLDDNKTCQDINECEHPG LCGPQGECLNTEGSFHCVCQQGFSISADGRTCEDID ECVNNTVCDSHGFCDNTAGSFRCLCYQGFQAPQDGQ GCVDVNECELLSGVCGEAFCENVEGSFLCVCADENQ EYSPMTGQCRSRTSTDLDVDVDQPKEEKKECYYNLN DASLCDNVLAPNVTKQECCCTSGVGWGDNCEIFPCP VLGTAEFTEMCPKGKGFVPAGESSSEAGGENYKDAD ECLLFGQEICKNGFCLNTRPGYECYCKQGTYYDPVK LQCFDMDECQDPSSCIDGQCVNTEGSYNCFCTHPMV LDASEKRCIRPAESNEQIEETDVYQDLCWEHLSDEY VCSRPLVGKQTTYTECCCLYGEAWGMQCALCPLKDS DDYAQLCNIPVTGRRQPYGRDALVDFSEQYTPEADP YFIQDRFLNSFEELQAEECGILNGCENGRCVRVQEG YTCDCFDGYHLDTAKMTCVDVNECDELNNRMSLCKN AKCINTDGSYKCLCLPGYVPSDKPNYCTPLNTALNL EKDSDLE | 156 |
| LTBP3 | GPAGERGAGGGGALARERFKVVFAPVICKRTCLKGQ CRDSCQQGSNMTLIGENGHSTDTLTGSGFRVVVCPL PCMNGGQCSSRNQCLCPPDFTGRFCQVPAGGAGGGT GGSGPGLSRTGALSTGALPPLAPEGDSVASKHAIYA VQVIADPPGPGEGPPAQHAAFLVPLGPGQISAEVQA | 157 |

TABLE 9-continued

LTBP sequences

| Protein | Sequence | SEQ ID NO |
|---|---|---|
| | PPPVVNVRVHHPPEASVQVHRIESSNAESAAPSQHL LPHPKPSHPRPPTQKPLGRCFQDTLPKQPCGSNPLP GLTKQEDCCGSIGTAWGQSKCHKCPQLQYTGVQKPG PVRGEVGADCPQGYKRLNSTHCQDINECAMPGVCRH GDCLNNPGSYRCVCPPGHSLGPSRTQCIADKPEEKS LCFRLVSPEHQCQHPLTTRLTRQLCCCSVGKAWGAR CQRCPTDGTAAFKEICPAGKGYHILTSHQTLTIQGE SDFSLFLHPDGPPKPQQLPESPSQAPPPEDTEEERG VTTDSPVSEERSVQQSHPTATTTPARPYPELISRPS PPTMRWFLPDLPPSRSAVEIAPTQVTETDECRLNQN ICGHGECVPGPPDYSCHCNPGYRSHPQHRYCVDVNE CEAEPCGPGRGICMNTGGSYNCHCNRGYRLHVGAGG RSCVDLNECAKPHLCGDGGFCINFPGHYKCNCYPGY RLKASRPPVCEDIDECRDPSSCPDGKCENKPGSFKC IACQPGYRSQGGGACRDVNECAEGSPCSPGWCENLP GSFRCTCAQGYAPAPDGRSCLDVDECEAGDVCDNGI CSNTPGSFQCQCLSGYHLSRDRSHCEDIDECDFPAA CIGGDCINTNGSYRCLCPQGHRLVGGRKCQDIDECS QDPSLCLPHGACKNLQGSYVCVCDEGFTPTQDQHGC EEVEQPHHKKECYLNFDDTVFCDSVLATNVTQQECC CSLGAGWGDHCEIYPCPVYSSAEFHSLCPDGKGYTQ DNNIVNYGIPAHRDIDECMLFGSEICKEGKCVNTQP GYECYCKQGFYYDGNLLECVDVDECLDESNCRNGVC ENTRGGYRCACTPPAEYSPAQRQCLSPEEMDVDECQ DPAACRPGRCVNLPGSYRCECRPPWVPGPSGRDCQL PESPAERAPERRDVCWSQRGEDGMCAGPLAGPALTF DDCCCRQGRGWGAQCRPCPPRGAGSHCPTSQSESNS FWDTSPLLLGKPPRDEDSSEEDSDECRCVSGRCVPR PGGAVCECPCGGFQLDASRARCVDIDECRELNQRGLL CKSERCVNTSGSFRCVCKAGFARSRPHGACVPQRRR | |

In some embodiments, LTBPs may comprise detectable labels. Detectable labels may be used to allow for detection and/or isolation of recombinant proteins comprising LTBPs. Some detectable labels may comprise biotin labels, polyhistidine tags and/or flag tags. Such tags may be used to isolate tagged proteins. Proteins produced may comprise additional amino acids encoding one or more 3C protease cleavage site. Such sites allow for cleavage at the 3C protease cleavage site upon treatment with 3C protease, including, but not limited to rhinovirus 3C protease. Such cleavage sites may be introduced to allow for removal of detectable labels from recombinant proteins.

In some embodiments, GARPs, including, but not limited to recombinant forms of GARP, may be complexed with recombinant GPCs. Some recombinant GPCs of the present invention may be co-expressed with GARPs to ensure proper folding and/or expression. In other embodiments, the GARP homologue, leucine rich repeat containing 33 (LRRC33,) or fragments and/or mutants thereof may be substituted for GARP [also referred to herein as leucine rich repeat containing 32 (LRRC32.)] Such LRRC33 fragments and/or mutants may comprise one or more regions from the LRRC33 sequence listed in Table 10 below. Recombinant GARPs may also comprise mutants and/or GARP fragments. Some recombinant GARPs may be soluble (referred to herein as sGARP).

In some embodiments, recombinant GARPs may comprise one or more amino acid sequences listed in Table 10. Some recombinant GARPs used herein may be expressed without the N-terminal residues AQ. Expressed GARPs may comprise detectable labels. Such detectable labels may be used to allow for detection and/or isolation. Some detectable labels may comprise biotin labels, polyhistidine tags and/or flag tags. Such tags may be used to isolate tagged proteins. Proteins produced may comprise additional amino acids encoding one or more 3C protease cleavage site. Such sites allow for cleavage at the 3C protease cleavage site upon treatment with 3C protease, including, but not limited to rhinovirus 3C protease. 3C protease cleavage sites may be introduced to allow for removal of detectable labels from recombinant proteins.

TABLE 10

GARP sequences

| Protein | Sequence | SEQ ID NO |
|---|---|---|
| GARP | AQHQDKVPCKMVDKKVSCQVLGLLQVPSVLPPDTETL DLSGNQLRSILASPLGFYTALRHLDLSTNEISFLQPG AFQALTHLEHLSLAHNRLAMATALSAGGLGPLPRVTS LDLSGNSLYSGLLERLLGEAPSLHTLSLAENSLTRLT RHTFRDMPALEQLDLHSNVLMDIEDGAFEGLPRLTHL NLSRNSLTCISDFSLQQLRVLDLSCNSIEAFQTASQP QAEFQLTWLDLRENKLLHFPDLAALPRLIYLNLSNNL IRLPTGPPQDSKGIHAPSEGWSALPLSAPSGNASGRP LSQLLNLDLSYNEIELIPDSFLEHLTSLCFLNLSRNC LRTFEARRLGSLPCLMLLDLSHNALETLELGARALGS LRTLLLQGNALRDLPPYTFANLASLQRLNLQGNRVSP CGGPDEPGPSGCVAFSGITSLRSLSLVDNEIELLRAG AFLHTPLTELDLSSNPGLEVATGALGGLEASLEVLAL QGNGLMVLQVDLPCFICLKRLNLAENRLSHLPAWTQA VSLEVLDLRNNSFSLLPGSAMGGLETSLRRLYLQGNP LSCCGNGWLAAQLHQGRVDVDATQDLICRFSSQEEVS LSHVRPEDCEKGGLKNINLIIILTFILVSAILLTTLA ACCCVRRQKFNQQYKA | 158 |
| sGARP | AQHQDKVPCKMVDKKVSCQVLGLLQVPSVLPPDTETL DLSGNQLRSILASPLGFYTALRHLDLSTNEISFLQPG AFQALTHLEHLSLAHNRLAMATALSAGGLGPLPRVTS LDLSGNSLYSGLLERLLGEAPSLHTLSLAENSLTRLT RHTFRDMPALEQLDLHSNVLMDIEDGAFEGLPRLTHL NLSRNSLTCISDFSLQQLRVLDLSCNSIEAFQTASQP QAEFQLTWLDLRENKLLHFPDLAALPRLIYLNLSNNL IRLPTGPPQDSKGIHAPSEGWSALPLSAPSGNASGRP LSQLLNLDLSYNEIELIPDSFLEHLTSLCFLNLSRNC LRTFEARRLGSLPCLMLLDLSHNALETLELGARALGS LRTLLLQGNALRDLPPYTFANLASLQRLNLQGNRVSP CGGPDEPGPSGCVAFSGITSLRSLSLVDNEIELLRAG AFLHTPLTELDLSSNPGLEVATGALGGLEASLEVLAL QGNGLMVLQVDLPCFICLKRLNLAENRLSHLPAWTQA VSLEVLDLRNNSFSLLPGSAMGGLETSLRRLYLQGNP LSCCGNGWLAAQLHQGRVDVDATQDLICRFSSQEEVS LSHVRPEDCEKGGLKNIN | 159 |
| LRRC33 | WRNRSGTATAASQGVCKLVGGAADCRGQSLASVPSSL PPHARMLTLDANPLKTLWNHSLQPYPLLESLSLHSCH LERISRGAFQEQGHLRSLVLGDNCLSENYEETAAALH ALPGLRRLDLSGNALTEDMAALMLQNLSSLRSVSLAG NTIMRLDDSVFEGLERLRELDLQRNYIFEIEGGAFDG LAELRHLNLAFNNLPCIVDFGLTRLRVLNVSYNVLEW FLATGGEAAFELETLDLSHNQLLFFPLLPQYSKLRTL LLRDNNMGFYRDLYNTSSPREMVAQFLLVDGNVTNIT TVSLWEEFSSSDLADLRFLDMSQNQFQYLPDGFLRKM PSLSHLNLHQNCLMTLHIREHEPPGALTELDLSHNQL SELHLAPGLASCLGSLRLFNLSSNQLLGVPPGLFANA RNITTLDMSHNQISLCPLPAASDRVGPPSCVDFRNMA SLRSLSLEGCGLGALPDCPFQGTSLTYLDLSSNWGVL NGSLAPLQDVAPMLQVLSLRNMGLHSSFMALDFSGFG NLRDLDLSGNCLTTFPRFGGSLALETLDLRRNSLTAL PQKAVSEQLSRGLRTIYLSQNPYDCCGVDGWGALQHG QTVADWAMVTCNLSSKIIRVTELPGGVPRDCKWERLD LGLLYLVLILPSCLTLLVACTVIVLTFKKPLLQVIKS RCHWSSVY | 160 |
| sLRRC33 | WRNRSGTATAASQGVCKLVGGAADCRGQSLASVPSSL PPHARMLTLDANPLKTLWNHSLQPYPLLESLSLHSCH LERISRGAFQEQGHLRSLVLGDNCLSENYEETAAALH ALPGLRRLDLSGNALTEDMAALMLQNLSSLRSVSLAG NTIMRLDDSVFEGLERLRELDLQRNYIFEIEGGAFDG LAELRHLNLAFNNLPCIVDFGLTRLRVLNVSYNVLEW FLATGGEAAFELETLDLSHNQLLFFPLLPQYSKLRTL LLRDNNMGFYRDLYNTSSPREMVAQFLLVDGNVTNIT | 161 |

TABLE 10-continued

GARP sequences

| Protein | Sequence | SEQ ID NO |
|---|---|---|
| | TVSLWEEFSSSDLADLRFLDMSQNQFQYLPDGFLRKM PSLSHLNLHQNCLMTLHIREHEPPGALTELDLSHNQL SELHLAPGLASCLGSLRLFNLSSNQLLGVPPGLFANA RNITTLDMSHNQISLCPLPAASDRVGPPSCVDFRNMA SLRSLSLEGCGLGALPDCPFQGTSLTYLDLSSNWGVL NGSLAPLQDVAPMLQVLSLRNMGLHSSFMALDFSGFG NLRDLDLSGNCLTTFPRFGGSLALETLDLRRNSLTAL PQKAVSEQLSRGLRTIYLSQNPYDCCGVDGWGALQHG QTVADWAMVTCNLSSKIIRVTELPGGVPRDCKWERLD LGL | |

GPCs bound to LTBPs may adopt three dimensional conformations that are distinct from conformations found with GPCs bound to GARP or other matrix proteins. This may be due, in some cases, to the presence of cysteines available on LTBP for disulfide bond formation with GPCs that comprise a different distance from one another than corresponding cysteines available for disulfide bond formation on GARP. Such differences in three dimensional conformations may provide unique conformation-dependent epitopes on GPCs. In some embodiments, antibodies of the invention are directed to such conformation-dependent epitopes. Such antibodies may function selectively to activate or inhibit growth factor activity depending on the identity of bound protein (e.g. LTBP or GARP.) In some cases, different conformation-dependent epitopes may be present on N-terminal alpha helices of proTGF-β when bound to LTBP or GARP.

Recombinant proteins of the present invention may be coexpressed with GDF-associated serum protein (GASP) 1 and/or GASP-2. Such recombinant proteins may include, but are not limited to GDF-8 and/or GDF-11. GASPs are circulating proteins that bind and prevent activity of GDF-8 and GDF-11 (Hill, J. J. et al., 2003. Mol Endocrinology. 17(6): 1144-54 and Hill, J. J. et al., 2002. JBC. 277(43):40735-41, the contents of each of which are herein incorporated by reference in their entirety.) Interestingly, GDF-8 and GDF-11 growth factors are not found free in serum. About 70% are in GPCs with the remaining 30% associated with GASPs as well as other proteins (e.g. follistatin, follistatin-like related gene and decorin.) Studies using mice lacking expression of GASP-1 and/or GASP-2 display phenotypes indicative of myostatin and/or GDF-11 overactivity (Lee et al., 2013. PNAS. 110(39):E3713-22.) GASP bound GDF-8 and/or GDF-11 are unable to bind type II receptors and transmit related cellular signals.

Some recombinant proteins may be coexpressed with perlecan. Such recombinant proteins may include, but are not limited to GDF-8. Studies by Sengle et al (Sengle et al., 2011. J Biol Chem. 286(7):5087-99, the contents of which are herein incorporated by reference in their entirety) found that the GDF-8 prodomain associates with perlecan. Further studies indicate that perlecan knockout leads to muscular hypertrophy, suggesting that the interaction between GDF-8 and perlecan may contribute to GDF-8 activity (Xu et al. 2010. Matrix Biol. 29(6):461-70.)

In some cases, recombinant proteins of the invention may be coexpressed with follistatin and/or FLRG. Such recombinant proteins may include, but are not limited to GDF-8. Both follistatin and FLRG are known to antagonize some TGF-β family member proteins, including, but not limited to GDF-8 (Lee, S-J. et al., 2010. Mol Endocrinol. 24(10):1998-2008, Takehara-Kasamatsu, Y. et al., 2007. J Med Invest. 54β-4): 276-88, the contents of each of which are herein incorporated by reference in their entirety.) Follistatin has been shown to block GDF-8 activity by binding to the free growth factor and preventing receptor binding. Both follistatin and FLRG are implicated in modulating growth factor activity during development.

In some embodiments, recombinant proteins of the invention may be coexpressed with decorin. Such recombinant proteins may include, but are not limited to TGF-β and GDF-8. Decorin is a known antagonist of TGF-β activity (Zhu, J. et al., 2007. J Biol Chem. 282:25852-63, the cotents of which are herein incorporated by reference in their entirety) and may also antagonize other TGF-β family members, including, but not limited to GDF-8. Decorin-dependent inhibition of TGF-β and GDF-8 activity has been shown to reduce fibrosis in various tissues. Decorin expression has also been shown to increase the expression of follistatin, a known inhibitor of free GDF-8.

Figure 7:
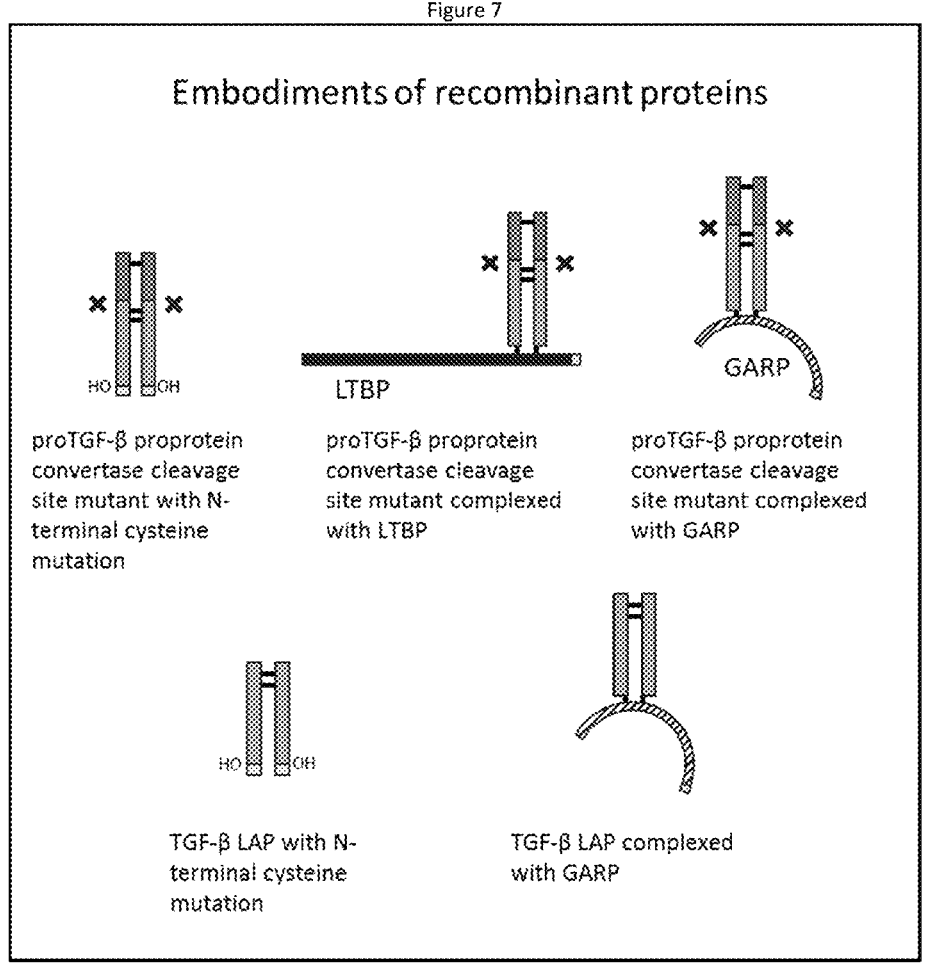
FIG. 7 depicts schematic representations of five recombinant proteins alone or in complex with LTBP or GARP.
Figure 10:
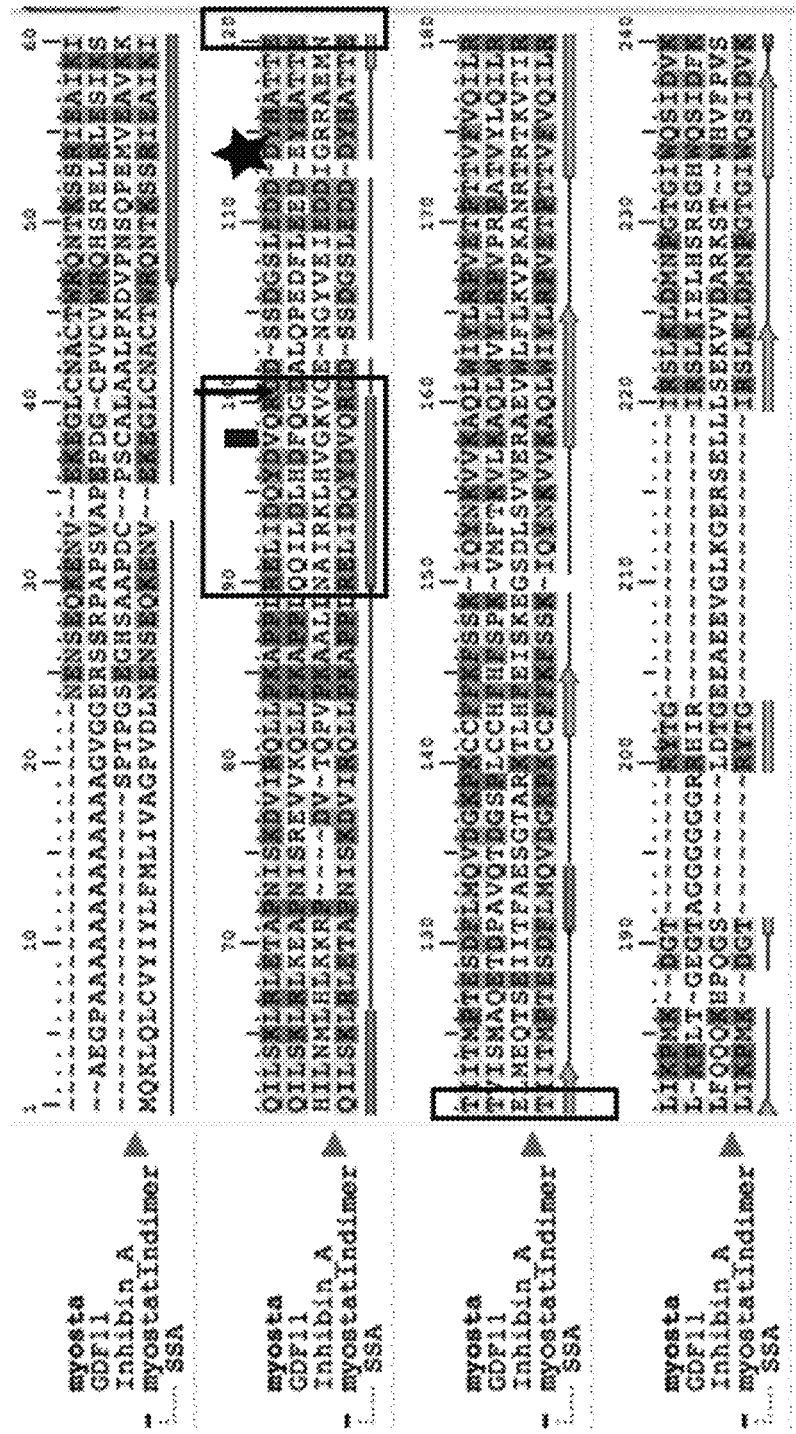
FIG. 10 presents an alignment conducted between GDF-8 (myostatin,) (SEQ ID NO: GDF-11 (SEQ ID NO: 4), Inhibin A (SEQ ID NO: 6) and a GDF-8 dimer (SEQ ID NO: 297). Arrows indicate cleavage sites. Regions involved in internal interactions are boxed. Solid rectangles appear above residues predicted to be involved in steric clashes in chimeric constructs. Stars denote important break points in protein modules.
Figure 10:
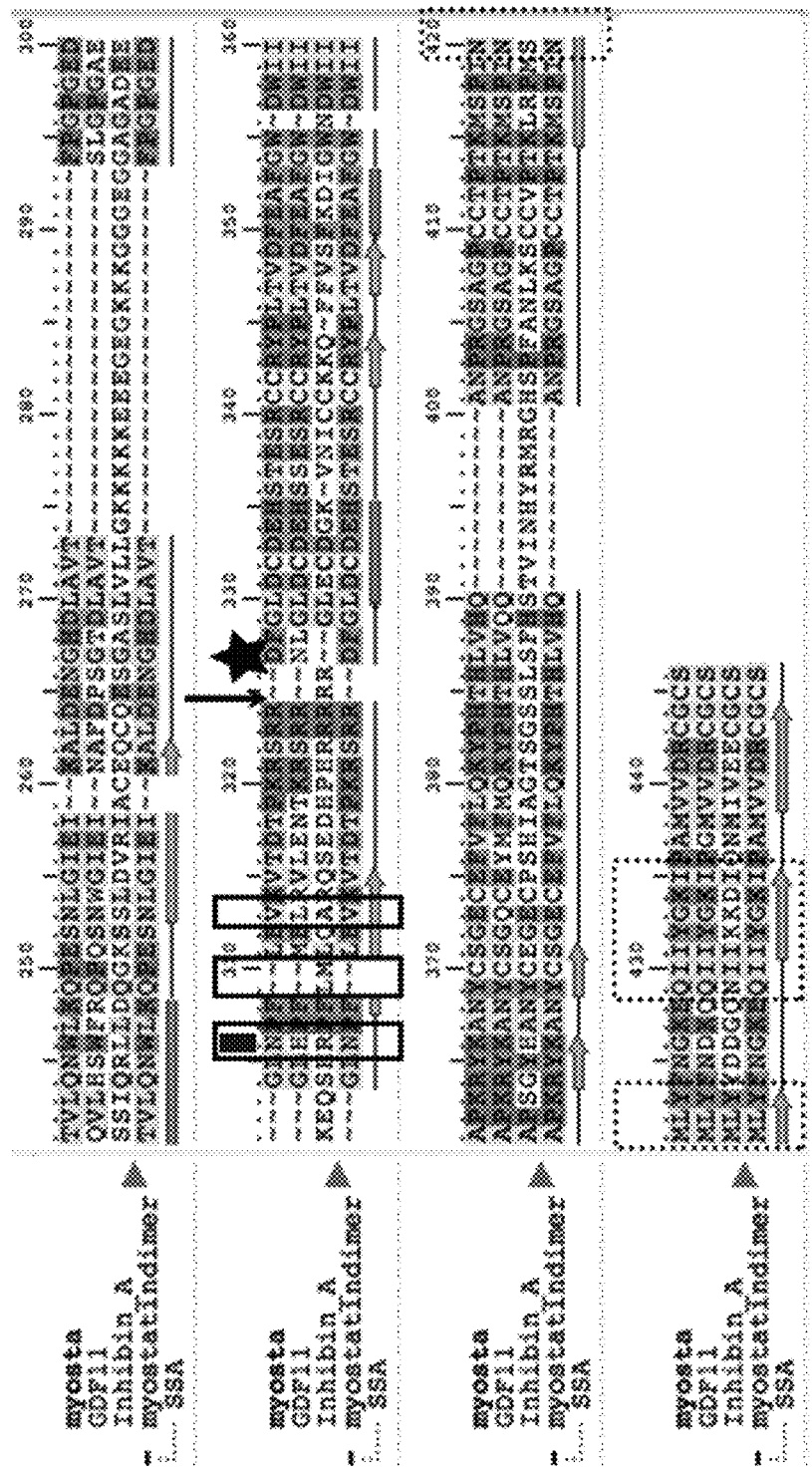

In some embodiments, recombinant proteins of the present invention may comprise those depicted in FIG. 7. Some recombinant proteins of the present invention may comprise one or more features and/or combinations of protein modules from the embodiments depicted in FIG. 7.

Recombinant Growth Differentiation Factors (GDFs,) Activins and Inhibins

Growth differentiation factors (GDFs), activins and inhibins are TGF-β family member proteins involved in a number of cellular and/or developmental activities. In some embodiments of the present invention, recombinant proteins may comprise one or more protein modules from one or more GDFs, activins and/or inhibins. In further embodiments, GDF protein modules may comprise GDF-8 and/or GDF-11 protein modules.

GDF-8 and GDF-11, which are secreted as latent complexes (Sengle et al., 2011. J Biol Chem. 286(7):5087-99; Ge et al., 2005. Mol Cel Biol. 25(14):5846-58,) show conservation of the fastener residues (Lys 27 and Tyr 75 of TGF-β1; see FIGS. 8A-8G.) GDF-8 (also referred to herein as myostatin) is involved in regulating muscle mass, and its deficiency increases muscle mass in multiple species, including humans (Rodino-Klapac, L. R. et al., 2009. Muscle Nerve. 39(3):283-96). GDF-8 may be found in the circulation in latent form, but may also be stored in the extracellular matrix, bound to LTBP3 (Anderson et al., 2007. J Biol Chem. 283 (11):7027-35) or perlecan (Sengle et al., 2011. J Biol Chem. 286(7):5087-99.) While complexed with its prodomain, GDF-8 is unable to participate in receptor binding with the type II receptor, ActRIIB (Sengle et al., 2008. J Mol Biol. 381(4):1025-39.) While GDF-8 is expressed primarily in muscle, GDF-11 expression is more systemic and its activity is thought to be involved in multiple processes (Lee et al., 2013. PNAS. 110(39):E3713-22.). It is believed to be involved in development of multiple tissues, including, but not limited to the retina, kidney, pancreas and olfactory system. It is also believed to be a circulating factor in the blood (Sinha, M. et al., 2014. Science Express. 10.1126/science.1251152, p2-6 and Katsimpardi, L. et al., 2014. Science Express. 10.1126/science.1251141, the contents of each of which are herein incorporated by reference in their entirety.)

GDF-8 and GDF-11 also share considerable homology. While the prodomains only share 48% homology, GDF-8 and GDF-11 growth factor domains share 90% homology (60% homology when prodomains and growth factors are taken together.)

Release of GDF-8 and GDF-11 from latent GPCs requires cleavage of the prodomains at the BMP/tolloid cleavage site (located between Arg 75 and Asp 76 in GDF-8 and between Gly 97 and Asp 98 in GDF-11) by BMP1/tolloid metalloproteinases. This cleavage is between the α2 helix and the fastener. Thus at least two different methods of unfastening the straitjacket, force and proteolysis, can release family members from latency.

In some embodiments, recombinant proteins of the present invention comprising GDFs may comprise sequences listed in Table 11 or fragments thereof

TABLE 11

Recombinant GDFs

| Protein | Sequence | SEQ ID NO |
|---|---|---|
| proGDF-8 | NENSEQKENVEKEGLCNACTWRQNTKSSRIEAIKI QILSKLRLETAPNISKDVIRQLLPKAPPLRELIDQ YDVQRDDSSDGSLEDDDYHATTETIITMPTESDFL MQVDGKPKCCFFKFSSKIQYNKVVKAQLWIYLRPV ETPTTVFVQILRLIKPMKDGTRYTGIRSLKLDMNP GTGIWQSIDVKTVLQNWLKQPESNLGIEIKALDEN GHDLAVTFPGPGEDGLNPFLEVKVTDTPKRSRRDF GLDCDEHSTESRCCRYPLTVDFEAFGWDWIIAPKR YKANYCSGECEFVFLQKYPHTHLVHQANPRGSAGP CCTPTKMSPINMLYFNGKEQIIYGKIPAMVVDRCG CS | 5 |
| GDF-8 prodomain | NENSEQKENVEKEGLCNACTWRQNTKSSRIEAIKI QILSKLRLETAPNISKDVIRQLLPKAPPLRELIDQ YDVQRDDSSDGSLEDDDYHATTETIITMPTESDFL MQVDGKPKCCFFKFSSKIQYNKVVKAQLWIYLRPV ETPTTVFVQILRLIKPMKDGTRYTGIRSLKLDMNP GTGIWQSIDVKTVLQNWLKQPESNLGIEIKALDEN GHDLAVTFPGPGEDGLNPFLEVKVTDTPKRSRR | 70 |
| GDF-8 prodomain D76A | NENSEQKENVEKEGLCNACTWRQNTKSSRIEAIKI QILSKLRLETAPNISKDVIRQLLPKAPPLRELIDQ YDVQRADSSDGSLEDDDYHATTETIITMPTESDFL MQVDGKPKCCFFKFSSKIQYNKVVKAQLWIYLRPV ETPTTVFVQILRLIKPMKDGTRYTGIRSLKLDMNP GTGIWQSIDVKTVLQNWLKQPESNLGIEIKALDEN GHDLAVTFPGPGEDGLNPFLEVKVTDTPKRSRR | 162 |
| proGDF-8 AXXA | NENSEQKENVEKEGLCNACTWRQNTKSSRIEAIKI QILSKLRLETAPNISKDVIRQLLPKAPPLRELIDQ YDVQRDDSSDGSLEDDDYHATTETIITMPTESDFL MQVDGKPKCCFFKFSSKIQYNKVVKAQLWIYLRPV ETPTTVFVQILRLIKPMKDGTRYTGIRSLKLDMNP GTGIWQSIDVKTVLQNWLKQPESNLGIEIKALDEN GHDLAVTFPGPGEDGLNPFLEVKVTDTPKASRADF GLDCDEHSTESRCCRYPLTVDFEAFGWDWIIAPKR YKANYCSGECEFVFLQKYPHTHLVHQANPRGSAGP CCTPTKMSPINMLYFNGKEQIIYGKIPAMVVDRCG CS | 163 |
| proGDF-8 D76A | NENSEQKENVEKEGLCNACTWRQNTKSSRIEAIKI QILSKLRLETAPNISKDVIRQLLPKAPPLRELIDQ YDVQRADSSDGSLEDDDYHATTETIITMPTESDFL MQVDGKPKCCFFKFSSKIQYNKVVKAQLWIYLRPV ETPTTVFVQILRLIKPMKDGTRYTGIRSLKLDMNP GTGIWQSIDVKTVLQNWLKQPESNLGIEIKALDEN GHDLAVTFPGPGEDGLNPFLEVKVTDTPKRSRRDF GLDCDEHSTESRCCRYPLTVDFEAFGWDWIIAPKR YKANYCSGECEFVFLQKYPHTHLVHQANPRGSAGP CCTPTKMSPINMLYFNGKEQIIYGKIPAMVVDRCG CS | 164 |
| proGDF-8 AXXA D76A | NENSEQKENVEKEGLCNACTWRQNTKSSRIEAIKI QILSKLRLETAPNISKDVIRQLLPKAPPLRELIDQ YDVQRADSSDGSLEDDDYHATTETIITMPTESDFL MQVDGKPKCCFFKFSSKIQYNKVVKAQLWIYLRPV ETPTTVFVQILRLIKPMKDGTRYTGIRSLKLDMNP GTGIWQSIDVKTVLQNWLKQPESNLGIEIKALDEN GHDLAVTFPGPGEDGLNPFLEVKVTDTPKASRADF GLDCDEHSTESRCCRYPLTVDFEAFGWDWIIAPKR YKANYCSGECEFVFLQKYPHTHLVHQANPRGSAGP CCTPTKMSPINMLYFNGKEQIIYGKIPAMVVDRCG CS | 165 |

TABLE 11-continued

Recombinant GDFs

| Protein | Sequence | SEQ ID NO |
|---|---|---|
| proGDF-11 | AEGPAAAAAAAAAAAAAAGVGGERSSRPAPSVAPEP VDGCPVCWRQHSRELRLESIKSQILSKLRLKEAPN ISREVVKQLLPKAPPLQQILDLHDFQGDALQPEDF LEEDEYHATTETVISMAQETDPAVQTDGSPLCCHF HFSPKVMFTKVLKAQLWVYLRPVPRPATVYLQILR LKPLTGEGTAGGGGGGRRHIRIRSLKIELHSRSGH WQSIDFKQVLHSWFRQPQSNWGIEINAFDPSGTDL AVTSLGPGAEGLHPFMELRVLENTKRSRRNLGLDC DEHSSESRCCRYPLTVDFEAFGWDWIIAPKRYKAN YCSGQCEYMFMQKYPHTHLVQQANPRGSAGPCCTP TKMSPINMLYFNDKQQIIYGKIPGMVVDRCGCS | 4 |
| proGDF-11 D98A | AEGPAAAAAAAAAAAAAAGVGGERSSRPAPSVAPEP DGCPVCWRQHSRELRLESIKSQILSKLRLKEAPN ISREVVKQLLPKAPPLQQILDLHDFQGAALQPEDF LEEDEYHATTETVISMAQETDPAVQTDGSPLCCHF HFSPKVMFTKVLKAQLWVYLRPVPRPATVYLQILR LKPLTGEGTAGGGGGGRRHIRIRSLKIELHSRSGH WQSIDFKQVLHSWFRQPQSNWGIEINAFDPSGTDL AVTSLGPGAEGLHPFMELRVLENTKRSRRNLGLDC DEHSSESRCCRYPLTVDFEAFGWDWIIAPKRYKAN YCSGQCEYMFMQKYPHTHLVQQANPRGSAGPCCTP TKMSPINMLYFNDKQQIIYGKIPGMVVDRCGCS | 166 |
| proGDF-11 D2G | AEGPAAAAAAAAAAAAAAGVGGERSSRPAPSVAPEP DGCPVCWRQHSRELRLESIKSQILSKLRLKEAPN ISREVVKQLLPKAPPLQQILDLHDFQGDALQPEDF LEEDEYHATTETVISMAQETDPAVQTDGSPLCCHF HFSPKVMFTKVLKAQLWVYLRPVPRPATVYLQILR LKPLTGEGTAGGGGGGRRHIRIRSLKIELHSRSGH WQSIDFKQVLHSWFRQPQSNWGIEINAFDPSGTDL AVTSLGPGAEGLHPFMELRVLENTKRSGNLGLDCD EHSSESRCCRYPLTVDFEAFGWDWIIAPKRYKANY CSGQCEYMFMQKYPHTHLVQQANPRGSAGPCCTPT KMSPINMLYFNDKQQIIYGKIPGMVVDRCGCS | 167 |
| proGDF-11 AxxA | AEGPAAAAAAAAAAAAAAGVGGERSSRPAPSVAPEP DGCPVCWRQHSRELRLESIKSQILSKLRLKEAPN ISREVVKQLLPKAPPLQQILDLHDFQGDALQPEDF LEEDEYHATTETVISMAQETDPAVQTDGSPLCCHF HFSPKVMFTKVLKAQLWVYLRPVPRPATVYLQILR LKPLTGEGTAGGGGGGRRHIRIRSLKIELHSRSGH WQSIDFKQVLHSWFRQPQSNWGIEINAFDPSGTDL AVTSLGPGAEGLHPFMELRVLENTKASRANLGLDC DEHSSESRCCRYPLTVDFEAFGWDWIIAPKRYKAN YCSGQCEYMFMQKYPHTHLVQQANPRGSAGPCCTP TKMSPINMLYFNDKQQIIYGKIPGMVVDRCGCS | 168 |
| proGDF-11 AxxA D98A | AEGPAAAAAAAAAAAAAAGVGGERSSRPAPSVAPEP DGCPVCWRQHSRELRLESIKSQILSKLRLKEAPN ISREVVKQLLPKAPPLQQILDLHDFQGAALQPEDF LEEDEYHATTETVISMAQETDPAVQTDGSPLCCHF HFSPKVMFTKVLKAQLWVYLRPVPRPATVYLQILR LKPLTGEGTAGGGGGGRRHIRIRSLKIELHSRSGH WQSIDFKQVLHSWFRQPQSNWGIEINAFDPSGTDL AVTSLGPGAEGLHPFMELRVLENTKASRANLGLDC DEHSSESRCCRYPLTVDFEAFGWDWIIAPKRYKAN YCSGQCEYMFMQKYPHTHLVQQANPRGSAGPCCTP TKMSPINMLYFNDKQQIIYGKIPGMVVDRCGCS | 169 |
| GDF-11 prodomain D98A | AEGPAAAAAAAAAAAAAAGVGGERSSRPAPSVAPEP DGCPVCWRQHSRELRLESIKSQILSKLRLKEAPN ISREVVKQLLPKAPPLQQILDLHDFQGAALQPEDF LEEDEYHATTETVISMAQETDPAVQTDGSPLCCHF HFSPKVMFTKVLKAQLWVYLRPVPRPATVYLQILR LKPLTGEGTAGGGGGGRRHIRIRSLKIELHSRSGH WQSIDFKQVLHSWFRQPQSNWGIEINAFDPSGTDL AVTSLGPGAEGLHPFMELRVLENTKRSRR | 170 |
| GDF-11 prodomain | AEGPAAAAAAAAAAAAAAGVGGERSSRPAPSVAPEP DGCPVCWRQHSRELRLESIKSQILSKLRLKEAPN | 71 |

TABLE 11-continued

Recombinant GDFs

| Protein | Sequence | SEQ ID NO |
|---------|----------|-----------|
| | ISREVVKQLLPKAPPLQQILDLHDFQGDALQPEDF LEEDEYHATTETVISMAQETDPAVQTDGSPLCCHF HFSPKVMFTKVLKAQLWVYLRPVPRPATVYLQILR LKPLTGEGTAGGGGGGRRHIRIRSLKIELHSRSGH WQSIDFKQVLHSWFRQPQSNWGIEINAFDPSGTDL AVTSLGPGAEGLHPFMELRVLENTKRSRR | |

Activins and inhibins are TGF-β family member proteins, the activity of each of which often results in opposing functions (Bilezikjian et al 2012.) Like other family members, these proteins occur physiologically as dimers. Activins and inhibins are constructed in part from the same β-subunits, that may include inhibin-beta A, inhibin-beta B, inhibin-beta C and inhibin-beta E (referred to herein as β-subunit A, B, C and E, respectively.) The difference between activins and inhibins, structurally, is that activins are β-subunit dimers while inhibins are heterodimers, wherein the second subunit is inhibin-α. Activins are named for their subunit pairs, such that activin A comprises a homodimer of two A subunits, activin AB comprises a dimer of A and B subunits, B comprises a dimer of B subunits, etc. (Muenster et al 2011.) Activins are involved in a variety of functions that may include, but are not limited to cell growth, differentiation, programmed cell death, endocrine functions, cellular metabolism, bone growth, etc. They are especially recognized for their control of reproductive hormone cycles. Activin and inhibin signaling often functions antagonistically in this regard.

In some embodiments, recombinant proteins of the present invention may comprise integrins. Integrins are cell surface heterodimers formed by alpha and beta subunits, each of which has a transmembrane domain and in the N-terminal portion of the extracellular domain come together to form the ligand binding site. Recombinant proteins of the present invention may comprise integrins and/or integrin subunits. Such integrins and/or integrin subunits may comprise any of those disclosed in U.S. Provisional Patent Application No. 61/722,919 filed Nov. 6, 2012, the contents of which are herein incorporated by reference in their entirety.

Recombinant proteins of the invention may include intercellular adhesion molecule 1 (ICAM-1). In some cases, ICAM-1 proteins of the present invention may be used as control proteins during antibody development and/or antibody testing. In some cases, ICAM-1 may be used as a control during selection of binding molecules using phage display technologies. In some cases, ICAM-1 proteins of the invention comprise one or more detectable label. Detectable labels may include, for example, histidine tags.

Chimeric Proteins

In some embodiments, recombinant proteins of the present invention may comprise chimeric proteins. As used herein, the term "chimeric protein" refers to a protein comprising one or more protein modules from at least two different proteins [formed from the same gene (e.g. variants arising from alternative splicing) or from different genes]. Chimeric proteins may comprise protein modules from two or more TGF-β family member proteins. Such chimeric proteins may comprise protein modules from TGF-β1, TGF-β2 and/or TGF-β3. Some chimeric proteins of the present invention may comprise protein modules including, but not limited to the protein modules and/or amino acid sequences listed in Table 12 (residue numbers correspond to the pro-protein sequences listed in Table 1.) Some chimeric proteins of the present invention may comprise protein modules comprising amino acid sequences similar to those in Table 12, but comprising additional or fewer amino acids than those listed. Such modules may comprise about 1 more or fewer amino acids, about 2 more or fewer amino acids, about 3 more or fewer amino acids, about 4 more or fewer amino acids, about 5 more or fewer amino acids, about 6 more or fewer amino acids, about 7 more or fewer amino acids, about 8 more or fewer amino acids, about 9 more or fewer amino acids, about 10 more or fewer amino acids or greater than 10 more or fewer amino acids on N-terminal and/or C-terminal ends.

TABLE 12

Protein modules

| Protein | Residues | Sequence | SEQ ID NO |
|---------|----------|----------|-----------|
| TGF-β1 | 1-74 | LSTCKTIDMELVKRKRIEAIRGQILSKLRL ASPPSQGEVPPGPLPEAVLALYNSTRDRVA GESAEPEPEPEADY | 171 |
| TGF-β1 | 1-207 | LSTCKTIDMELVKRKRIEAIRGQILSKLRL ASPPSQGEVPPGPLPEAVLALYNSTRDRVA GESAEPEPEPEADYYAKEVTRVLMVETHNE IYDKFKQSTHSIYMFFNTSELREAVPEPVL LSRAELRLLRLKLKVEQHVELYQKYSNNSW RYLSNRLLAPSDSPEWLSFDVTGVVRQWLS RGGEIEGFRLSAHCSCDSRDNTLQVDI | 172 |
| TGF-β1 | 46-end | EAVLALYNSTRDRVAGESAEPEPEPEADYY AKEVTRVLMVETHNEIYDKFKQSTHSIYMF FNTSELREAVPEPVLLSRAELRLLRLKLKV EQHVELYQKYSNNSWRYLSNRLLAPSDSPE WLSFDVTGVVRQWLSRGGEIEGFRLSAHCS CDSRDNTLQVDINGFTTGRRGDLATIHGMN RPFLLLMATPLERAQHLQSSRHRRALDTNY CFSSTEKNCCVRQLYIDFRKDLGWKWIHEP KGYHANFCLGPCPYIWSLDTQYSKVLALYN QHNPGASAAPCCVPQALEPLPIVYYVGRKP KVEQLSNMIVRSCKCS | 173 |
| TGF-β1 | 47-end | AVLALYNSTRDRVAGESAEPEPEPEADYYA KEVTRVLMVETHNEIYDKFKQSTHSIYMFF NTSELREAVPEPVLLSRAELRLLRLKLKVE QHVELYQKYSNNSWRYLSNRLLAPSDSPEW LSFDVTGVVRQWLSRGGEIEGFRLSAHCSC DSRDNTLQVDINGFTTGRRGDLATIHGMNR PFLLLMATPLERAQHLQSSRHRRALDTNYC FSSTEKNCCVRQLYIDFRKDLGWKWIHEPK GYHANFCLGPCPYIWSLDTQYSKVLALYNQ HNPGASAAPCCVPQALEPLPIVYYVGRKPK VEQLSNMIVRSCKCS | 174 |
| TGF-β1 | 74-249 | YYAKEVTRVLMVETHNEIYDKFKQSTHSIY MFFNTSELREAVPEPVLLSRAELRLLRLKL KVEQHVELYQKYSNNSWRYLSNRLLAPSDS PEWLSFDVTGVVRQWLSRGGEIEGFRLSAH CSCDSRDNTLQVDINGFTTGRRGDLATIHG MNRPFLLLMATPLERAQHLQSSRHRR | 175 |
| TGF-β1 | 74-end | YYAKEVTRVLMVETHNEIYDKFKQSTHSIY MFFNTSELREAVPEPVLLSRAELRLLRLKL KVEQHVELYQKYSNNSWRYLSNRLLAPSDS PEWLSFDVTGVVRQWLSRGGEIEGFRLSAH CSCDSRDNTLQVDINGFTTGRRGDLATIHG MNRPFLLLMATPLERAQHLQSSRHRRALDT NYCFSSTEKNCCVRQLYIDFRKDLGWKWIH EPKGYHANFCLGPCPYIWSLDTQYSKVLAL YNQHNPGASAAPCCVPQALEPLPIVYYVGR KPKVEQLSNMIVRSCKCS | 176 |
| TGF-β1 | 75-249 | YAKEVTRVLMVETHNEIYDKFKQSTHSIYM FFNTSELREAVPEPVLLSRAELRLLRLKLK | 177 |

TABLE 12-continued

| Protein | Residues | Sequence | SEQ ID NO |
|---|---|---|---|
| TGF-β1 | 75-end | YAKEVTRVLMVETHNEIYDKFKQSTHSIYM FFNTSELREAVPEPVLLSRAELRLLRLKLK VEQHVELYQKYSNNSWRYLSNRLLAPSDSP EWLSFDVTGVVRQWLSRGGEIEGFRLSAHC SCDSRDNTLQVDINGFTTGRRGDLATIHGM NRPFLLLMATPLERAQHLQSSRHRRALDTN YCFSSTEKNCCVRQLYIDFRKDLGWKIHE PKGYHANFCLGPCPYIWSLDTQYSKVLALY NQHNPGASAAPCCVPQALEPLPIVYYVGRK PKVEQLSNMIVRSCKCS | 178 |
| TGF-β1 | 228-361 | FLLLMATPLERAQHLQSSRHRRALDTNYCF SSTEKNCCVRQLYIDFRKDLGWKIHEPKG YHANFCLGPCPYIWSLDTQYSKVLALYNQH NPGASAAPCCVPQALEPLPIVYYVGRKPKV EQLSNMIVRSCKCS | 179 |
| TGF-β1 | 250-361 | ALDTNYCFSSTEKNCCVRQLYIDFRKDLGW KWIHEPKGYHANFCLGPCPYIWSLDTQYSK VLALYNQHNPGASAAPCCVPQALEPLPIVY YVGRKPKVEQLSNMIVRSCKCS | 44 |
| TGF-β2 | 232-260 | FAGIDGTSTYTSGDQKTIKSTRKKNSGKTP | 65 |
| TGF-β2 | 236-254 | GTSTYTSGDQKTIKSTRKK | 180 |
| TGF-β3 | 1-46 | SLSLSTCTTLDFGHIKKKRVEAIRGQILSK LRLTSPPEPTVMTHVP | 43 |
| TGF-β3 | 1-79 | SLSLSTCTTLDFGHIKKKRVEAIRGQILSK LRLTSPPEPTVMTHVPYQVLALYNSTRELL EEMHGEREEGCTQENTESE | 181 |
| TGF-β3 | 80-280 | YYAKEIHKFDMIQGLAEHNELAVCPKGITS KVFRFNVSSVEKNRTNLFRAEFRVLRVPNP SSKRNEQRIELFQILRPDEHIAKQRYIGGK NLPTRGTAEWLSFDVTDTVREWLLRRESNL GLEISIHCPCHTFQPNGDILENIHEVMEIK FKGVDNEDDHGRGDLGRLKKQKDHHNPHLI LMMIPPHRLDNPGQGGQRKKR | 182 |
| TGF-β3 | 281-392 | ALDTNYCFRNLEENCCVRPLYIDFRQDLGW KWVHEPKGYYANFCSGPCPYLRSADTTHST VLGLYNTLNPEASASPCCVPQDLEPLTILY YVGRTPKVEQLSNMVVKSCKCS | 46 |
| GDF-8 | 1-75 | NENSEQKENVEKEGLCNACTWRQNTKSSRI EAIKIQILSKLRLETAPNISKDVIRQLLPK APPLRELIDQYDVQR | 183 |
| GDF-8 | 1-64 | NENSEQKENVEKEGLCNACTWRQNTKSSRI EAIKIQILSKLRLETAPNISKDVIRQLLPK APPL | 72 |
| GDF-8 | 75-end | RDDSSDGSLEDDDYHATTETIITMPTESDF LMQVDGKPKCCFFKFSSKIQYNKVVKAQLW IYLRPVETPTTVFVQILRLIKPMKDGTRYT GIRSLKLDMNPGTGIWQSIDVKTVLQNWLK QPESNLGIEIKALDENGHDLAVTFPGPGED GLNPFLEVKVTDTPKRSRRDFGLDCDEHST ESRCCRYPLTVDFEAFGWDWIIAPKRYKAN YCSGECEFVFLQKYPHTLVHQANPRGSAG PCCTPTKMSPINMLYFNGKEQIIYGKIPAM VVDRCGCS | 184 |
| GDF8 | 65-end | RELIDQYDVQRDDSSDGSLEDDDYHATTET IITMPTESDFLMQVDGKPKCCFFKFSSKIQ YNKVVKAQLWIYLRPVETPTTVFVQILRLI KPMKDGTRYTGIRSLKLDMNPGTGIWQSID VKTVLQNWLKQPESNLGIEIKALDENGHDL AVTFPGPGEDGLNPFLEVKVTDTPKRSRRD FGLDCDEHSTESRCCRYPLTVDFEAFGWDW IIAPKRYKANYCSGECEFVFLQKYPHTHLV HQANPRGSAGPCCTPTKMSPINMLYFNGKE QIIYGKIPAMVVDRCGCS | 185 |
| GDF8 | 65-243 | RELIDQYDVQRDDSSDGSLEDDDYHATTET IITMPTESDFLMQVDGKPKCCFFKFSSKIQ YNKVVKAQLWIYLRPVETPTTVFVQILRLI KPMKDGTRYTGIRSLKLDMNPGTGIWQSID VKTVLQNWLKQPESNLGIEIKALDENGHDL AVTFPGPGEDGLNPFLEVKVTDTPKRSRR | 77 |
| GDF-8 | 76-243 | DDSSDGSLEDDDYHATTETIITMPTESDFL MQVDGKPKCCFFKFSSKIQYNKVVKAQLWI YLRPVETPTTVFVQILRLIKPMKDGTRYTG IRSLKLDMNPGTGIWQSIDVKTVLQNWLKQ PESNLGIEIKALDENGHDLAVTFPGPGEDG LNPFLEVKVTDTPKRSRR | 186 |
| GDF-8 | 244-352 | DFGLDCDEHSTESRCCRYPLTVDFEAFGWD WIIAPKRYKANYCSGECEFVFLQKYPHTHL VHQANPRGSAGPCCTPTKMSPINMLYFNGK EQIIYGKIPAMVVDRCGCS | 74 |
| GDF-11 | 1-86 | AEGPAAAAAAAAAAAAAGVGGERSSRPAPS VAPEPDGCPVCVWRQHSRELRLESIKSQIL SKLRLKEAPNISREVVKQLLPKAPPL | 73 |
| GDF-11 | 1-96 | AEGPAAAAAAAAAAAAAGVGGERSSRPAPS VAPEPDGCPVCVWRQHSRELRLESIKSQIL SKLRLKEAPNISREVVKQLLPKAPPLQQIL DLHDFQ | 187 |
| GDF-11 | 1-108 | AEGPAAAAAAAAAAAAAGVGGERSSRPAPS VAPEPDGCPVCVWRQHSRELRLESIKSQIL SKLRLKEAPNISREVVKQLLPKAPPLQQIL DLHDFQGDALQPEDFLEE | 188 |
| GDF-11 | 97-274 | GDALQPEDFLEEDEYHATTETVISMAQETD PAVQTDGSPLCCHFHFSPKVMFTKVLKAQL WVYLRPVPRPATVYLQILRLKPLTGEGTAG GGGGGRRHIRIRSLKIELHSRSGHWQSIDF KQVLHSWFRQPQSNWGIEINAFDPSGTDLA VTSLGPGAEGLHPFMELRVLENTKRSRR | 189 |
| GDF-11 | 87-274 | QQILDLHDFQGDALQPEDFLEEDEYHATTE TVISMAQETDPAVQTDGSPLCCHFHFSPKV MFTKVLKAQLWVYLRPVPRPATVYLQILRL KPLTGEGTAGGGGGGRRHIRIRSLKIELHS RSGHWQSIDFKQVLHSWFRQPQSNWGIEIN AFDPSGTDLAVTSLGPGAEGLHPFMELRVL ENTKRSRR | 78 |
| GDF-11 | 275-383 | NLGLDCDEHSSESRCCRYPLTVDFEAFGWD WIIAPKRYKANYCSGQCEYMFMQKYPHTHL VQQANPRGSAGPCCTPTKMSPINMLYFNDK QQIIYGKIPGMVVDRCGCS | 75 |
| Inhibin Beta A | 1-64 | SPTPGSEGHSAAPDCPSCALAALPKDVPNS QPEMVEAVKKHILNMLHLKKRPDVTQPVPK AALL | 190 |
| Inhibin Beta A | 1-76 | SPTPGSEGHSAAPDCPSCALAALPKDVPNS QPEMVEAVKKHILNMLHLKKRPDVTQPVPK AALLNAIRKLHVGKVG | 191 |
| Inhibin Beta A | 65-288 | NAIRKLHVGKVGENGYVEIEDDIGRRAEMN ELMEQTSEIITFAESGTARKTLHFEISKEG SDLSVVERAEVWLFLKVPKANRTRTKVTIR LFQQQKHPQGSLDTEEEAEEVGLKGERSEL LLSEKVVDARKSTWHVFPVSSSIQRLLDQG KSSLDVRIACEQCQESGASLVLLGKKKKKE | 192 |

TABLE 12-continued

Protein modules

| Protein | Residues | Sequence | SEQ ID NO |
|---------|----------|----------|-----------|
| | | EEGEGKKKGGGEGGAGADEEKEQSHRPFLM<br>LQARQSEDHPHRRR | |
| Inhibin Beta A | 65-289 | NAIRKLHVGKVGENGYVEIEDDIGRRAEMN<br>ELMEQTSEIITFAESGTARKTLHFEISKEG<br>SDLSVVERAEVWLFLKVPKANRTRTKVTIR<br>LFQQQKHPQGSLDTGEEAEEVGLKGERSEL<br>LLSEKVVDARKSTWHVFPVSSSIQRLLDQG<br>KSSLDVRIACEQCQESGASLVLLGKKKKKE<br>EEGEGKKKGGGEGGAGADEEKEQSHRPFLM<br>LQARQSEDHPHRRRR | 193 |
| Inhibin Beta A | 65-290 | NAIRKLHVGKVGENGYVEIEDDIGRRAEMN<br>ELMEQTSEIITFAESGTARKTLHFEISKEG<br>SDLSVVERAEVWLFLKVPKANRTRTKVTIR<br>LFQQQKHPQGSLDTGEEAEEVGLKGERSEL<br>LLSEKVVDARKSTWHVFPVSSSIQRLLDQG<br>KSSLDVRIACEQCQESGASLVLLGKKKKKE<br>EEGEGKKKGGGEGGAGADEEKEQSHRPFLM<br>LQARQSEDHPHRRRRR | 194 |
| Inhibin Beta A | 77-289 | ENGYVEIEDDIGRRAEMNELMEQTSEIITF<br>AESGTARKTLHFEISKEGSDLSVVERAEVW<br>LFLKVPKANRTRTKVTIRLFQQQKHPQGSL<br>DTGEEAEEVGLKGERSELLLSEKVVDARKS<br>TWHVFPVSSSIQRLLDQGKSSLDVRIACEQ<br>CQESGASLVLLGKKKKKEEEGEGKKKGGGE<br>GGAGADEEKEQSHRPFLMLQARQSEDHPHR<br>RRR | 195 |
| Inhibin Beta A | 77-290 | ENGYVEIEDDIGRRAEMNELMEQTSEIITF<br>AESGTARKTLHFEISKEGSDLSVVERAEVW<br>LFLKVPKANRTRTKVTIRLFQQQKHPQGSL<br>DTGEEAEEVGLKGERSELLLSEKVVDARKS<br>TWHVFPVSSSIQRLLDQGKSSLDVRIACEQ<br>CQESGASLVLLGKKKKKEEEGEGKKKGGGE<br>GGAGADEEKEQSHRPFLMLQARQSEDHPHR<br>RRRR | 196 |
| Inhibin Beta A | 77-end | ENGYVEIEDDIGRRAEMNELMEQTSEIITF<br>AESGTARKTLHFEISKEGSDLSVVERAEVW<br>LFLKVPKANRTRTKVTIRLFQQQKHPQGSL<br>DTGEEAEEVGLKGERSELLLSEKVVDARKS<br>TWHVFPVSSSIQRLLDQGKSSLDVRIACEQ<br>CQESGASLVLLGKKKKKEEEGEGKKKGGGE<br>GGAGADEEKEQSHRPFLMLQARQSEDHPHR<br>RRRRGLECDGKVNICCKKQFFVSFKDIGWN<br>DWIIAPSGYHANYCEGECPSHIAGTSGSSL<br>SFHSTVINHYRMRGHSPFANLKSCCVPTKL<br>RPMSMLYYDDGQNIIKKDIQNMIVEECGCS | 197 |
| Inhibin Beta A | 291-406 | GLECDGKVNICCKKQFFVSFKDIGWNDWII<br>APSGYHANYCEGECPSHIAGTSGSSLSFHS<br>TVINHYRMRGHSPFANLKSCCVPTKLRPMS<br>MLYYDDGQNIIKKDIQNMIVEECGCS | 198 |

In some embodiments, chimeric proteins of the present invention may comprise combinations of any of the protein modules listed in Table 12. Some chimeric proteins comprising GPCs may comprise protein modules that have been substituted with any of the protein modules listed in Table 12.

In some embodiments, chimeric proteins may comprise protein modules from GDFs and/or inhibins. Such GDFs may include GDF-11 and/or GDF-8. Some such chimeric proteins may comprise a prodomain from GDF-11 and a growth factor from GDF-8. In such embodiments, chimeric proteins may comprise substituted N-terminal regions between GDF-11 and GDF-8. In other embodiments, chimeric proteins may comprise a prodomain from GDF-8 and a growth factor from GDF-11. Such chimeric proteins may comprise amino acid residues 1-108 from GDF-11 and amino acid residues 90-the end of the protein from GDF-8. Some chimeric proteins may comprise an arm region from GDF-11.

Some chimerics of the present invention may comprise GDF-8 comprising an arm region of GDF-11. Such chimerics may be unstable due to steric clash between residue F95 from the GDF-11 arm and the α2 helix of the chimeric GPC. Therefore, in some cases, GDF8/GDF11/Activin chimeras may be designed so that the ARM region of such chimeric proteins contains the α2 helix.

TABLE 13-continued

Protein module combinations

| Protein module 1 | Protein module 2 | Protein module 3 | Chimeric Sequence | SEQ ID NO |
|---|---|---|---|---|
| | | | KTIKSTRKKNSGKTPHLLLMLLPSYRLESQQTNRR<br>KKRALDTNYCFSSTEKNCCVRQLYIDFRKDLGWK<br>WIHEPKGYHANFCLGPCPYIWSLDTQYSKVLALY<br>NQHNPGASAAPCCVPQALEPLPIVYYVGRKPKVE<br>QLSNMIVRSCKCS | |
| TGF-β3 LAP | TGF-β1 growth factor | N/A | SLSLSTCTTLDFGHIKKKRVEAIRGQILSKLRLTSP<br>PEPTVMTHVPYQVLALYNSTRELLEEMHGEREEG<br>CTQENTESEYYAKEIHKFDMIQGLAEHNELAVCP<br>KGITSKVFRFNVSSVEKNRTNLFRAEFRVLRVPNP<br>SSKRNEQRIELFQILRPDEHIAKQRYIGGKNLPTRG<br>TAEWLSFDVTDTVREWLLRRESNLGLEISIHCPCH<br>TFQPNGDILENIHEVMEIKFKGVDNEDDHGRGDL<br>GRLKKQKDHHNPHLILMMIPPHRLDNPGQGGQR<br>KKRALDTNYCFSSTEKNCCVRQLYIDFRKDLGWK<br>WIHEPKGYHANFCLGPCPYIWSLDTQYSKVLALY<br>NQHNPGASAAPCCVPQALEPLPIVYYVGRKPKVE<br>QLSNMIVRSCKCS | 200 |
| TGF-β3 (1-46) | TGF-β1 (47-end) | N/A | SLSLSTCTTLDFGHIKKKRVEAIRGQILSKLRLTSP<br>PEPTVMTHVPAVLALYNSTRDRVAGESAEPEPEP<br>EADYYAKEVTRVLMVETHNEIYDKFKQSTHSIYM<br>FFNTSELREAVPEPVLLSRAELRLLRLKLKVEQHV<br>ELYQKYSNNSWRYLSNRLLAPSDSPEWLSFDVTG<br>VVRQWLSRGGEIEGFRLSAHCSCDSRDNTLQVDI<br>NGFTTGRRGDLATIHGMNRPFLLLMATPLERAQH<br>LQSSRHRRALDTNYCFSSTEKNCCVRQLYIDFRK<br>DLGWKWIHEPKGYHANFCLGPCPYIWSLDTQYS<br>KVLALYNQHNPGASAAPCCVPQALEPLPIVYYVG<br>RKPKVEQLSNMIVRSCKCS | 201 |
| TGF-β3 (1-79) | TGF-β1 (75-end) | N/A | SLSLSTCTTLDFGHIKKKRVEAIRGQILSKLRLTSP<br>PEPTVMTHVPYQVLALYNSTRELLEEMHGEREEG<br>CTQENTESEYAKEVTRVLMVETHNEIYDKFKQST<br>HSIYMFFNTSELREAVPEPVLLSRAELRLLRLKLK<br>VEQHVELYQKYSNNSWRYLSNRLLAPSDSPEWLS<br>FDVTGVVRQWLSRGGEIEGFRLSAHCSCDSRDNT<br>LQVDINGFTTGRRGDLATIHGMNRPFLLLMATPL<br>ERAQHLQSSRHRRALDTNYCFSSTEKNCCVRQLY<br>IDFRKDLGWKWIHEPKGYHANFCLGPCPYIWSLD<br>TQYSKVLALYNQHNPGASAAPCCVPQALEPLPIV<br>YYVGRKPKVEQLSNMIVRSCKCS | 202 |
| TGF-β1 (1-74) | TGF-β3 (80-280) | TGF-β1 (250-361) | LSTCKTIDMELVKRKRIEAIRGQILSKLRLASPPSQ<br>GEVPPGPLPEAVLALYNSTRDRVAGESAEPEPEPE<br>ADYYYAKEIHKFDMIQGLAEHNELAVCPKGITSK<br>VFRFNVSSVEKNRTNLFRAEFRVLRVPNPSSKRNE<br>QRIELFQILRPDEHIAKQRYIGGKNLPTRGTAEWL<br>SFDVTDTVREWLLRRESNLGLEISIHCPCHTFQPN<br>GDILENIHEVMEIKFKGVDNEDDHGRGDLGRLKK<br>QKDHHNPHLILMMIPPHRLDNPGQGGQRKKRAL<br>DTNYCFSSTEKNCCVRQLYIDFRKDLGWKWIHEP<br>KGYHANFCLGPCPYIWSLDTQYSKVLALYNQHNP<br>GASAAPCCVPQALEPLPIVYYVGRKPKVEQLSNM<br>IVRSCKCS | 203 |
| TGF-β3 (1-79) | TGF-β1 (75-249) | TGF-β3 (281-392) | SLSLSTCTTLDFGHIKKKRVEAIRGQILSKLRLTSP<br>PEPTVMTHVPYQVLALYNSTRELLEEMHGEREEG<br>CTQENTESEYAKEVTRVLMVETHNEIYDKFKQST<br>HSIYMFFNTSELREAVPEPVLLSRAELRLLRLKLK<br>VEQHVELYQKYSNNSWRYLSNRLLAPSDSPEWLS<br>FDVTGVVRQWLSRGGEIEGFRLSAHCSCDSRDNT<br>LQVDINGFTTGRRGDLATIHGMNRPFLLLMATPL<br>ERAQHLQSSRHRRALDTNYCFRNLEENCCVRPLY<br>IDFRQDLGWKWVHEPKGYYANFCSGPCPYLRSA<br>DTTHSTVLGLYNTLNPEASASPCCVPQDLEPLTIL<br>YYVGRTPKVEQLSNMVVKSCKCS | 204 |
| TGF-β1 (1-207) | TGF-β2 trigger loop Short (236-254) | TGF-β1 (228-361) | LSTCKTIDMELVKRKRIEAIRGQILSKLRLASPPSQ<br>GEVPPGPLPEAVLALYNSTRDRVAGESAEPEPEPE<br>ADYYAKEVTRVLMVETHNEIYDKFKQSTHSIYMF<br>FNTSELREAVPEPVLLSRAELRLLRLKLKVEQHVE<br>LYQKYSNNSWRYLSNRLLAPSDSPEWLSFDVTGV<br>VRQWLSRGGEIEGFRLSAHCSCDSRDNTLQVDIG | 205 |

TABLE 13-continued

Protein module combinations

| Protein module 1 | Protein module 2 | Protein module 3 | Chimeric Sequence | SEQ ID NO |
|---|---|---|---|---|
| | | | TSTYTSGDQKTIKSTRKKFLLLMATPLERAQHLQS<br>SRHRRALDTNYCFSSTEKNCCVRQLYIDFRKDLG<br>WKWIHEPKGYHANFCLGPCPYIWSLDTQYSKVL<br>ALYNQHNPGASAAPCCVPQALEPLPIVYYVGRKP<br>KVEQLSNMIVRSCKCS | |
| TGF-β1 (1-207) | TGF-β2 trigger loop Long (232-260) | TGF-β1 (228-361) | LSTCKTIDMELVKRKRIEAIRGQILSKLRLASPPSQ<br>GEVPPGPLPEAVLALYNSTRDRVAGESAEPEPEPE<br>ADYYAKEVTRVLMVETHNEIYDKFKQSTHSIYMF<br>FNTSELREAVPEPVLLSRAELRLLRLKLKVEQHVE<br>LYQKYSNNSWRYLSNRLLAPSDSPEWLSFDVTGV<br>VRQWLSRGGEIEGFRLSAHCSCDSRDNTLQVDIA<br>GIDGTSTYTSGDQKTIKSTRKKNSGKTPFLLLMAT<br>PLERAQHLQSSRHRRALDTNYCFSSTEKNCCVRQ<br>LYIDFRKDLGWKWIHEPKGYHANFCLGPCPYIWS<br>LDTQYSKVLALYNQHNPGASAAPCCVPQALEPLP<br>IVYYVGRKPKVEQLSNMIVRSCKCS | 206 |
| GDF-11 (1-96) | GDF-8 (76-243) | GDF-11 (275-383) | AEGPAAAAAAAAAAAAAGVGGERSSRPAPSVAP<br>EPDGCPVCVWRQHSRELRLESIKSQILSKLRLKEA<br>PNISREVVKQLLPKAPPLQQILDLHDFQDDSSDGS<br>LEDDDYHATTETIITMPTESDFLMQVDGKPKCCFF<br>KFSSKIQYNKVVKAQLWIYLRPVETPTTVFVQILR<br>LIKPMKDGTRYTGIRSLKLDMNPGTGIWQSIDVKT<br>VLQNWLKQPESNLGIEIKALDENGHDLAVTFPGP<br>GEDGLNPFLEVKVTDTPKRSRRNLGLDCDEHSSE<br>SRCCRYPLTVDFEAFGWDWIIAPKRYKANYCSGQ<br>CEYMFMQKYPHTHLVQQANPRGSAGPCCTPTKM<br>SPINMLYFNDKQQIIYGKIPGMVVDRCGCS | 207 |
| GDF-11 (1-86) | GDF-8 (65-243) | GDF-11 (275-383) | AEGPAAAAAAAAAAAAAGVGGERSSRPAPSVAP<br>EPDGCPVCVWRQHSRELRLESIKSQILSKLRLKEA<br>PNISREVVKQLLPKAPPLRELIDQYDVQRDDSSDG<br>SLEDDDYHATTETIITMPTESDFLMQVDGKPKCCF<br>FKFSSKIQYNKVVKAQLWIYLRPVETPTTVFVQIL<br>RLIKPMKDGTRYTGIRSLKLDMNPGTGIWQSIDV<br>KTVLQNWLKQPESNLGIEIKALDENGHDLAVTFP<br>GPGEDGLNPFLEVKVTDTPKRSRRNLGLDCDEHS<br>SESRCCRYPLTVDFEAFGWDWIIAPKRYKANYCS<br>GQCEYMFMQKYPHTHLVQQANPRGSAGPCCTPT<br>KMSPINMLYFNDKQQIIYGKIPGMVVDRCGCS | 208 |
| GDF-11 (1-96) | GDF-8 (76-243) | N/A | AEGPAAAAAAAAAAAAAGVGGERSSRPAPSVAP<br>EPDGCPVCVWRQHSRELRLESIKSQILSKLRLKEA<br>PNISREVVKQLLPKAPPLQQILDLHDFQDDSSDGS<br>LEDDDYHATTETIITMPTESDFLMQVDGKPKCCFF<br>KFSSKIQYNKVVKAQLWIYLRPVETPTTVFVQILR<br>LIKPMKDGTRYTGIRSLKLDMNPGTGIWQSIDVKT<br>VLQNWLKQPESNLGIEIKALDENGHDLAVTFPGP<br>GEDGLNPFLEVKVTDTPKRSRR | 209 |
| GDF-11 (1-86) | GDF-8 (65-243) | NA | AEGPAAAAAAAAAAAAAGVGGERSSRPAPSVAP<br>EPDGCPVCVWRQHSRELRLESIKSQILSKLRLKEA<br>PNISREVVKQLLPKAPPLRELIDQYDVQRDDSSDG<br>SLEDDDYHATTETIITMPTESDFLMQVDGKPKCCF<br>FKFSSKIQYNKVVKAQLWIYLRPVETPTTVFVQIL<br>RLIKPMKDGTRYTGIRSLKLDMNPGTGIWQSIDV<br>KTVLQNWLKQPESNLGIEIKALDENGHDLAVTFP<br>GPGEDGLNPFLEVKVTDTPKRSRR | 210 |
| GDF-11 (1-96) | Inhibin Beta A (77-290) | GDF-11 (275-383) | AEGPAAAAAAAAAAAAAGVGGERSSRPAPSVAP<br>EPDGCPVCVWRQHSRELRLESIKSQILSKLRLKEA<br>PNISREVVKQLLPKAPPLQQILDLHDFQENGYVEI<br>EDDIGRRAEMNELMEQTSEIITFAESGTARKTLHF<br>EISKEGSDLSVVERAEVWLFLKVPKANRTRTKVTI<br>RLFQQQKHPQGSLDTGEEAEEVGLKGERSELLLS<br>EKVVDARKSTWHVFPVSSSIQRLLDQGKSSLDVRI<br>ACEQCQESGASLVLLGKKKKKEEEGEGKKKGGG<br>EGGAGADEEKEQSHRPFLMLQARQSEDHPHRRR<br>RRNLGLDCDEHSSESRCCRYPLTVDFEAFGWDWI<br>IAPKRYKANYCSGQCEYMFMQKYPHTHLVQQAN<br>PRGSAGPCCTPTKMSPINMLYFNDKQQIIYGKIPG<br>MVVDRCGCS | 211 |

TABLE 13-continued

Protein module combinations

| Protein module 1 | Protein module 2 | Protein module 3 | Chimeric Sequence | SEQ ID NO |
|---|---|---|---|---|
| GDF-11 (1-86) | Inhibin Beta A (65-290) | GDF-11 (275-383) | AEGPAAAAAAAAAAAAAGVGGERSSRPAPSVAP EPDGCPVCVWRQHSRELRLESIKSQILSKLRLKEA PNISREVVKQLLPKAPPLNAIRKLHVGKVGENGY VEIEDDIGRRAEMNELMEQTSEIITFAESGTARKTL HFEISKEGSDLSVVERAEVWLFLKVPKANRTRTK VTIRLFQQQKHPQGSLDTGEEAEEVGLKGERSELL LSEKVVDARKSTWHVFPVSSSIQRLLDQGKSSLD VRIACEQCQESGASLVLLGKKKKKEEEGEGKKKG GGEGGAGADEEKEQSHRPFLMLQARQSEDHPHR RRRRNLGLDCDEHSSESRCCRYPLTVDFEAFGWD WIIAPKRYKANYCSGQCEYMFMQKYPHTHLVQQ ANPRGSAGPCCTPTKMSPINMLYFNDKQQIIYGKI PGMVVDRCGCS | 212 |
| GDF-11 (1-96) | Inhibin Beta A (77-290) | N/A | AEGPAAAAAAAAAAAAAGVGGERSSRPAPSVAP EPDGCPVCVWRQHSRELRLESIKSQILSKLRLKEA PNISREVVKQLLPKAPPLQQILDLHDFQENGYVEI EDDIGRRAEMNELMEQTSEIITFAESGTARKTLHF EISKEGSDLSVVERAEVWLFLKVPKANRTRTKVTI RLFQQQKHPQGSLDTGEEAEEVGLKGERSELLLS EKVVDARKSTWHVFPVSSSIQRLLDQGKSSLDVRI ACEQCQESGASLVLLGKKKKKEEEGEGKKKGGG EGGAGADEEKEQSHRPFLMLQARQSEDHPHRRRR RR | 213 |
| GDF-11 (1-86) | Inhibin Beta A (65-290) | NA | AEGPAAAAAAAAAAAAAGVGGERSSRPAPSVAP EPDGCPVCVWRQHSRELRLESIKSQILSKLRLKEA PNISREVVKQLLPKAPPLNAIRKLHVGKVGENGY VEIEDDIGRRAEMNELMEQTSEIITFAESGTARKTL HFEISKEGSDLSVVERAEVWLFLKVPKANRTRTK VTIRLFQQQKHPQGSLDTGEEAEEVGLKGERSELL LSEKVVDARKSTWHVFPVSSSIQRLLDQGKSSLD VRIACEQCQESGASLVLLGKKKKKEEEGEGKKKG GGEGGAGADEEKEQSHRPFLMLQARQSEDHPHR RRRR | 214 |
| GDF-8 (1-75) | GDF-11 (97-274) | GDF-8 (244-352) | NENSEQKENVEKEGLCNACTWRQNTKSSRIEAIKI QILSKLRLETAPNISKDVIRQLLPKAPPLRELIDQY DVQRGDALQPEDFLEEDEYHATTETVISMAQETD PAVQTDGSPLCCHFHFSPKVMFTKVLKAQLWVY LRPVPRPATVYLQILRLKPLTGEGTAGGGGGGRR HIRIRSLKIELHSRSGHWQSIDFKQVLHSWFRQPQS NWGIEINAFDPSGTDLAVTSLGPGAEGLHPFMELR VLENTKRSRRDFGLDCDEHSTESRCCRYPLTVDFE AFGWDWIIAPKRYKANYCSGECEFVFLQKYPHTH LVHQANPRGSAGPCCTPTKMSPINMLYFNGKEQII YGKIPAMVVDRCGCS | 215 |
| GDF-8 (1-64) | GDF-11 (87-274) | GDF-8 (244-352) | NENSEQKENVEKEGLCNACTWRQNTKSSRIEAIKI QILSKLRLETAPNISKDVIRQLLPKAPPLQQILDLH DFQGDALQPEDFLEEDEYHATTETVISMAQETDP AVQTDGSPLCCHFHFSPKVMFTKVLKAQLWVYL RPVPRPATVYLQILRLKPLTGEGTAGGGGGGRRHI RIRSLKIELHSRSGHWQSIDFKQVLHSWFRQPQSN WGIEINAFDPSGTDLAVTSLGPGAEGLHPFMELRV LENTKRSRRDFGLDCDEHSTESRCCRYPLTVDFEA FGWDWIIAPKRYKANYCSGECEFVFLQKYPHTHL VHQANPRGSAGPCCTPTKMSPINMLYFNGKEQIIY GKIPAMVVDRCGCS | 216 |
| GDF-8 (1-75) | GDF-11 (97-274) | N/A | NENSEQKENVEKEGLCNACTWRQNTKSSRIEAIKI QILSKLRLETAPNISKDVIRQLLPKAPPLRELIDQY DVQRGDALQPEDFLEEDEYHATTETVISMAQETD PAVQTDGSPLCCHFHFSPKVMFTKVLKAQLWVY LRPVPRPATVYLQILRLKPLTGEGTAGGGGGGRR HIRIRSLKIELHSRSGHWQSIDFKQVLHSWFRQPQS NWGIEINAFDPSGTDLAVTSLGPGAEGLHPFMELR VLENTKRSRR | 217 |
| GDF-8 (1-64) | GDF-11 (87-274) | GDF-8 (244-352) | NENSEQKENVEKEGLCNACTWRQNTKSSRIEAIKI QILSKLRLETAPNISKDVIRQLLPKAPPLQQILDLH DFQGDALQPEDFLEEDEYHATTETVISMAQETDP AVQTDGSPLCCHFHFSPKVMFTKVLKAQLWVYL RPVPRPATVYLQILRLKPLTGEGTAGGGGGGRRHI | 218 |

TABLE 13-continued

Protein module combinations

| Protein module 1 | Protein module 2 | Protein module 3 | Chimeric Sequence | SEQ ID NO |
|---|---|---|---|---|
| | | | RIRSLKIELHSRSGHWQSIDFKQVLHSWFRQPQSN WGIEINAFDPSGTDLAVTSLGPGAEGLHPFMELRV LENTKRSRRDFGLDCDEHSTESRCCRYPLTVDFEA FGWDWIIAPKRYKANYCSGECEFVFLQKYPHTHL VHQANPRGSAGPCCTPTKMSPINMLYFNGKEQIIY GKIPAMVVDRCGCS | |
| GDF-8 (1-75) | Inhibin Beta A (77-289) | GDF-8 (244-352) | NENSEQKENVEKEGLCNACTWRQNTKSSRIEAIKI QILSKLRLETAPNISKDVIRQLLPKAPPLRELIDQY DVQRENGYVEIEDDIGRRAEMNELMEQTSEIITFA ESGTARKTLHFEISKEGSDLSVVERAEVWLFLKVP KANRTRTKVTIRLFQQQKHPQGSLDTGEEAEEVG LKGERSELLLSEKVVDARKSTWHVFPVSSSI TABLE 13-continued Protein module combinations

| Protein module 1 | Protein module 2 | Protein module 3 | Chimeric Sequence | SEQ ID NO |
|---|---|---|---|---|
| | | | MRGHSPFANLKSCCVPTKLRPMSMLYYDDGQNII KKDIQNMIVEECGCS | |
| Inhibin Beta A (1-76) | GDF-8 (76-243) | N/A | SPTPGSEGHSAAPDCPSCALAALPKDVPNSQPEM VEAVKKHILNMLHLKKRPDVTQPVPKAALLNAIR KLHVGKVGDDSSDGSLEDDDYHATTETIITMPTES DFLMQVDGKPKCCFFKFSSKIQYNKVVKAQLWIY LRPVETPTTVFVQILRLIKPMKDGTRYTGIRSLKLD MNPGTGIWQSIDVKTVLQNWLKQPESNLGIEIKA LDENGHDLAVTFPGPGEDGLNPFLEVKVTDTPKR SRR | 225 |
| Inhibin Beta A (1-64) | GDF-8 (65-243) | NA | SPTPGSEGHSAAPDCPSCALAALPKDVPNSQPEM VEAVKKHILNMLHLKKRPDVTQPVPKAALLRELI DQYDVQRDDSSDGSLEDDDYHATTETIITMPTES DFLMQVDGKPKCCFFKFSSKIQYNKVVKAQLWIY LRPVETPTTVFVQILRLIKPMKDGTRYTGIRSLKLD MNPGTGIWQSIDVKTVLQNWLKQPESNLGIEIKA LDENGHDLAVTFPGPGEDGLNPFLEVKVTDTPKR SRR | 226 |
| Inhibin Beta A (1-76) | GDF-11 (97-274) | Inhibin Beta A (291-406) | SPTPGSEGHSAAPDCPSCALAALPKDVPNSQPEM VEAVKKHILNMLHLKKRPDVTQPVPKAALLNAIR KLHVGKVGGDALQPEDFLEEDEYHATTETVISMA QETDPAVQTDGSPLCCHFHFSPKVMFTKVLKAQL WVYLRPVPRPATVYLQILRLKPLTGEGTAGGGGG GRRHIRIRSLKIELHSRSGHWQSIDFKQVLHSWFR QPQSNWGIEINAFDPSGTDLAVTSLGPGAEGLHPF MELRVLENTKRSRRGLECDGKVNICCKKQFFVSF KDIGWNDWIIAPSGYHANYCEGECPSHIAGTSGSS LSFHSTVINHYRMRGHSPFANLKSCCVPTKLRPMS MLYYDDGQNIIKKDIQNMIVEECGCS | 227 |
| Inhibin Beta A (1-64) | GDF-11 (87-274) | Inhibin Beta A (291-406) | SPTPGSEGHSAAPDCPSCALAALPKDVPNSQPEM VEAVKKHILNMLHLKKRPDVTQPVPKAALLQQIL DLHDFQGDALQPEDFLEEDEYHATTETVISMAQE TDPAVQTDGSPLCCHFHFSPKVMFTKVLKAQLW VYLRPVPRPATVYLQILRLKPLTGEGTAGGGGG RRHIRIRSLKIELHSRSGHWQSIDFKQVLHSWFRQ PQSNWGIEINAFDPSGTDLAVTSLGPGAEGLHPFM ELRVLENTKRSRRGLECDGKVNICCKKQFFVSFK DIGWNDWIIAPSGYHANYCEGECPSHIAGTSGSSL SFHSTVINHYRMRGHSPFANLKSCCVPTKLRPMS MLYYDDGQNIIKKDIQNMIVEECGCS | 228 |
| Inhibin Beta A (1-76) | GDF-11 (97-274) | N/A | SPTPGSEGHSAAPDCPSCALAALPKDVPNSQPEM VEAVKKHILNMLHLKKRPDVTQPVPKAALLNAIR KLHVGKVGGDALQPEDFLEEDEYHATTETVISMA QETDPAVQTDGSPLCCHFHFSPKVMFTKVLKAQL WVYLRPVPRPATVYLQILRLKPLTGEGTAGGGGG GRRHIRIRSLKIELHSRSGHWQSIDFKQVLHSWFR QPQSNWGIEINAFDPSGTDLAVTSLGPGAEGLHPF MELRVLENTKRSRR | 229 |
| Inhibin Beta A (1-64) | GDF-11 (87-274) | NA | SPTPGSEGHSAAPDCPSCALAALPKDVPNSQPEM VEAVKKHILNMLHLKKRPDVTQPVPKAALLQQIL DLHDFQGDALQPEDFLEEDEYHATTETVISMAQE TDPAVQTDGSPLCCHFHFSPKVMFTKVLKAQLW VYLRPVPRPATVYLQILRLKPLTGEGTAGGGGG RRHIRIRSLKIELHSRSGHWQSIDFKQVLHSWFRQ PQSNWGIEINAFDPSGTDLAVTSLGPGAEGLHPFM ELRVLENTKRSRR | 230 |

Chimeric proteins may be used to characterize and/or map epitopes associated with GPCs. As used herein, the terms "map" or "mapping" refer to the identification, characterization and/or determination of one or more functional regions of one or more proteins. Such characterizations may be necessary for determining interactions between one or more protein modules and another agent (e.g. another protein and/or protein module.) Some chimeric proteins may be used to characterize functions associated with one or more proteins and/or protein modules.

In some embodiments, chimeric proteins of the present invention may comprise the sequences listed in Table 14 or fragments thereof.

TABLE 14

Chimeric proteins

| Protein | Sequence | SEQ ID NO |
|---|---|---|
| proTGF-β1arm3 C4S | LSTSKTIDMELVKRKRIEAIRGQILSKLRLAS PPSQGEVPPGPLPEAVLALYNSTRDRVAGESA EPEPEPEADYYAKEIHKFDMIQGLAEHNELAV CPKGITSKVFRFNVSSVEKNRTNLFRAEFRVL RVPNPSSKRNEQRIELFQILRPDEHIAKQRYI GGKNLPTRGTAEWLSFDVTDTVREWLLRRESN LGLEISIHCPCHTFQPNGDILENIHEVMEIKF KGVDNEDDHGRGDLGRLKKQKDHHNPHLILMM IPPHRLDNPGQGGQRKKRALDTNYCFSSTEKN CCVRQLYIDFRKDLGWKWIHEPKGYHANFCLG PCPYIWSLDTQYSKVLALYNQHNPGASAAPCC VPQALEPLPIVYYVGRKPKVEQLSNMIVRSCK CS | 231 |
| proTGF-β1Trigger Loop (short) β2 C4S | LSTSKTIDMELVKRKRIEAIRGQILSKLRLAS PPSQGEVPPGPLPEAVLALYNSTRDRVAGESA EPEPEPEADYYAKEVTRVLMVETHNEIYDKFK QSTHSIYMFFNTSELREAVPEPVLLSRAELRL LRLKLKVEQHVELYQKYSNNSWRYLSNRLLAP SDSPEWLSFDVTGVVRQWLSRGGEIEGFRLSA HCSCDSRDNTLQVDINGFTGTSTYTSGDQKTI KSTRKKHGMNRPFLLLMATPLERAQHLQSSRH RRALDTNYCFSSTEKNCCVRQLYIDFRKDLGW KWIHEPKGYHANFCLGPCPYIWSLDTQYSKVL ALYNQHNPGASAAPCCVPQALEPLPIVYYVGR KPKVEQLSNMIVRSCKCS | 232 |
| proTGF-β3arm1 C7S | SLSLSTSTTLDFGHIKKKRVEAIRGQILSKLR LTSPPPEPTVMTHVPYQVLALYNSTRELLEEMH GEREEGCTQENTESEYYAKEVTRVLMVETHNE IYDKFKQSTHSIYMFFNTSELREAVPEPVLLS RAELRLLRLKLKVEQHVELYQKYSNNSWRYLS NRLLAPSDSPEWLSFDVTGVVRQWLSRGGEIE GFRLSAHCSCDSRDNTLQVDINGFTTGRRGDL ATIHGMNRPFLLLMATPLERAQHLQSSRHRRA LDTNYCFRNLEENCCVRPLYIDFRQDLGWKWV HEPKGYYANFCSGPCPYLRSADTTHSTVLGLY NTLNPEASASPCCVPQDLEPLTILYYVGRTPK VEQLSNMVVKSCKCS | 233 |
| TGF-β1arm3 C4S (LAP) | LSTSKTIDMELVKRKRIEAIRGQILSKLRLAS PPSQGEVPPGPLPEAVLALYNSTRDRVAGESA EPEPEPEADYYAKEIHKFDMIQGLAEHNELAV CPKGITSKVFRFNVSSVEKNRTNLFRAEFRVL RVPNPSSKRNEQRIELFQILRPDEHIAKQRYI GGKNLPTRGTAEWLSFDVTDTVREWLLRRESN LGLEISIHCPCHTFQPNGDILENIHEVMEIKF KGVDNEDDHGRGDLGRLKKQKDHHNPHLILMM IPPHRLDNPGQGGQRKKR | 234 |
| TGF-β3arm1 C7S (LAP) | SLSLSTSTTLDFGHIKKKRVEAIRGQILSKLR LTSPPPEPTVMTHVPYQVLALYNSTRELLEEMH GEREEGCTQENTESEYYAKEVTRVLMVETHNE IYDKFKQSTHSIYMFFNTSELREAVPEPVLLS RAELRLLRLKLKVEQHVELYQKYSNNSWRYLS NRLLAPSDSPEWLSFDVTGVVRQWLSRGGEIE GFRLSAHCSCDSRDNTLQVDINGFTTGRRGDL ATIHGMNRPFLLLMATPLERAQHLQSSRHRR | 235 |
| TGF-β1 Trigger Loop (short) β2 C4S (LAP) | LSTSKTIDMELVKRKRIEAIRGQILSKLRLAS PPSQGEVPPGPLPEAVLALYNSTRDRVAGESA EPEPEPEADYYAKEVTRVLMVETHNEIYDKFK QSTHSIYMFFNTSELREAVPEPVLLSRAELRL LRLKLKVEQHVELYQKYSNNSWRYLSNRLLAP SDSPEWLSFDVTGVVRQWLSRGGEIEGFRLSA HCSCDSRDNTLQVDINGFTGTSTYTSGDQKTI KSTRKKHGMNRPFLLLMATPLERAQHLQSSRH RR | 236 |

In some embodiments, chimeric proteins may comprise one or more protein modules from TGF-β2. Although the crystal structure for the TGF-β2 growth factor has been elucidated (Daopin, S. et al., Crystal structure of transforming growth factor-β2: an unusual fold for the superfamily. Science. 1992. 257(5068):369-73,) activation mechanisms remain to be fully understood. Activation may be dependent upon one or more interactions between the TGF-β2 trigger loop and $α_9β_1$ integrin. The TGF-β2 trigger loop may comprise similar structural and/or functional features associated with RGD sequences. TGF-β2 trigger loops may bind integrins, including, but not limited to $α_9β_1$ integrins.

According to mouse tissue staining, integrin subunit $α_9$ is widely expressed in skeletal and cardiac muscle, visceral smooth muscle, hepatocytes, airway epithelium, squamous epithelium, choroid plexus epithelium and also on neutrophils (Palmer, E. L. et al., Sequence and tissue distribution of the integrin $α_9$ subunit, a novel partner of β1 that is widely distributed in epithelia and muscle. Journal of Cell Biology. 1993. 123(5):1289-97.) Expression of $α_9$ is not detected earlier than E12.5, suggesting that it does not play a major role in the earliest tissue morphogenesis (Wang, A. et al., Expression of the integrin subunit $α_9$ in the murine embryo. Developmental Dynamics. 1995. 204:421-31.) In vivo functions of $α_9$ are unclear. Phenotypes observed in knockout mice suggest a role in lymphatic valve development (Bazigou, E. et al., Integrin-$α_9$ is required for fibronectin matrix assembly during lymphatic valve morphogenesis. Dev Cell. 2009 August. 17(2): 175-86.) Reported interaction partners of integrin $α_9β_1$ include VCAM-1, the third FnIII domain on tenascin C, osteopontin, polydom/SVEP1, VEGF-A and NGF (Yokasaki, Y. et al., Identification of the ligand binding site for the integrin $α_9β_1$ in the third fibronectin type III repeat of tenascin C. The Journal of Biological Chemistry. 1998. 273 (19):11423-8; Marcinkiewicz, C. et al., Inhibitory effects of MLDG-containing heterodimeric disintegrins reveal distinct structural requirements for interaction of the integrin $α_9β_1$ with VCAM-1, tenascin-C, and osteopontin. JBC. 2000. 275 (41):31930-7; Oommen, S. et al., Vacular endothelial growth factor A (VEGF-A) induces endothelial and cancer cell migration through direct binding to integrin $α_9β_1$. JBC. 2011. 286(2):1083-92; Sato-Nishiuchi, R. et al., Polydom/SVEP1 is a ligand for integrin $α_9β_1$. JBC. 2012. 287(30):25615-30; Staniszewska, I. et al., Integrin $α_9β_1$ is a receptor for nerve growth factor and other neurotrophins. Journal of Cell Science. 2007. 121(Pt 4):504-13; Yokosaki, Y. et al., The integrin $α_9β_1$ binds to a novel recognition sequence (SVVYGLR; SEQ ID NO: 238) in the thrombin-cleaved amino-terminal fragment of osteopontin. JBC. 1999. 274(51):36328-34.)

Binding sites on proteins that interact with $α_9β_1$ have been mapped using linear peptides. These sites include binding sites on tenascin C (AEIDGIEL; SEQ ID NO: 237), osteopontin (SVVYGLR; SEQ ID NO: 238), polydom/SVEP1 (EDDMMEVPY; SEQ ID NO: 239) and VEGF-A (EYP). Unlike $α_4β_1$ and $α_5β_1$, $α_9β_1$ does not require a canonical RGD sequence motif. Some, but not all reported targets have an acidic residue/hydrophobic residue/proline motif. Some also comprise a tyrosine residue.

The trigger loop of TGF-β1 and TGF-β3 carries an RGD sequence where $αvβ_6$ and/or $αvβ_8$ bind to enable growth factor release. The TGF-β2 trigger loop region is different from those of TGF-β1 and TGF-β3, comprising the sequence FAGIDGTSTYTSGDQKTIKSTRKKNSGKTP (SEQ ID NO: 65), without an RGD trimer. Of this region, residues AGIDGTST (SEQ ID NO: 240) align with the peptide on the third FnIII domain of tenascin-C that has been mapped as an $α_9β_1$ binding site. Also, the tyrosine following this region may play a role in potential $α_9β_1$ binding. Therefore, $α_9β_1$ binding to TGF-β2 could be physiologically relevant. In some embodiments, chimeric proteins of the present invention may comprise trigger loop sequences comprising any of the sequences listed in Table 15.

TABLE 15

Trigger loop sequences

| Source protein | Trigger loop sequence | SEQ ID NO |
|---|---|---|
| TGF-β2 | FAGIDGTSTYTSGDQKTIKSTRKKNSGKTP | 65 |
| TGF-β2 | AGIDGTST | 240 |
| TGF-β2 (short) | GTSTYTSGDQKTIKSTRKK | 180 |
| TGF-β1 | INGFTTGRRGDLATIHGMNRP | 241 |
| TGF-β1 | SGRRGDLATI | 242 |
| TGF-β1 | TGRRGDLATI | 243 |
| TGF-β3 | FKGVDNEDDHGRGDLGRLKKQKDHHNP | 244 |
| GDF-8 | PGEDGLNP | 245 |
| GDF-11 | PGAEGLHP | 246 |
| Inhibin A | RPEATP | 247 |
| BMP-9 | SHRKGCDTLDISVPPGSRNLP | 248 |
| BMP-2 | RHVRISRSLHQDEHSWSQIRP | 249 |
| BMP-4 | QHVRISRSLPQGSGNWAQLRP | 250 |
| BMP-7 | IGRHGPQNKQP | 251 |
| BMP-6 | VGRDGPYDKQP | 252 |
| BMP-8 | LGQRAPRSQQP | 253 |
| Lefty1 | RFASQGAPAGLGEP | 254 |
| osteopontin | SVVYGLR | 238 |
| tenascin C | AEIDGIEL | 237 |
| polydom/SVEP1 | EDDMMEVPY | 239 |
| VEGF-A | EYP | — |

In some embodiments, chimeric proteins of the present invention may comprise one or more TGF-β2 trigger loops. Such chimeric proteins may exhibit activation (e.g. growth factor release) regulated in a manner similar to that of TGF-β2. Some chimeric proteins of the present invention may comprise TGF-β-related proteins wherein one or more protein modules are substituted with one or more protein modules comprising one or more TGF-β2 trigger loops. Some chimeric proteins comprise TGF-β-related proteins wherein one or more protein modules comprising at least one RGD sequence are substituted with one or more protein modules comprising one or more TGF-β2 trigger loops. In other embodiments, chimeric proteins may comprise TGF-β1 and/or TGF-β3 proteins wherein one or more protein modules comprising at least one RGD sequence are substituted with one or more protein modules comprising one or more TGF-β2 trigger loops. Such chimeric proteins may exhibit TGF-β1 activity.

In some embodiments, chimeric proteins of the present invention may comprise one or more protein modules from BMPs. Protein modules comprising sequences from BMPs may comprise sequences from any of those BMP modules disclosed in FIGS. 8A-8G. Chimeric proteins of the present invention comprising one or more BMP protein module may be useful for the development of antibodies and/or assays to study, enhance and/or perturb BMP interactions with other proteins, including, but not limited to RGM proteins.

Chimeric proteins may comprise detectable labels. Detectable labels may be used to allow for detection and/or isolation of chimeric proteins. Such detectable labels may comprise biotin labels, polyhistidine tags and/or flag tags. Tags may be used to identify and/or isolate tagged proteins. Proteins produced may comprise additional amino acids encoding one or more 3C protease cleavage site. Such sites allow for cleavage at the 3C protease cleavage site upon treatment with 3C protease, including, but not limited to rhinovirus 3C protease. 3C protease cleavage sites may be introduced to allow for removal of detectable labels from chimeric proteins.

Protein Expression

In some embodiments, synthesis of recombinant proteins of the present invention may be carried out according to any method known in the art. Some protein synthesis may be carried out in vitro. Some protein synthesis may be carried out using cells. Such cells may be bacterial and/or eukaryotic. In some embodiments, eukaryotic cells may be used for protein synthesis. Some such cells may be mammalian. Some mammalian cells used for protein expression may include, but are not limited to mouse cells, rabbit cells, rat cells, monkey cells, hamster cells and human cells. Such cells may be derived from a cell line. In other embodiments, human cells may be used. In further embodiments, cell lines may include, but are not limited to HEK293 cells, CHO cells, HeLa cells, Sw-480 cells, EL4 T lymphoma cells, TMLC cells, 293T/17 cells, Hs68 cells, CCD1112sk cells, HFF-1 cells, Keloid fibroblasts, A204 cells, L17 RIB cells and $C_2C_{12}$ cells.

In some embodiments, 293 cells are used for synthesis of recombinant proteins of the present invention. These cells are human cells that post-translationally modify proteins with human-like structures (e.g. glycans). Such cells are easily transfectable and scalable and are able to grow to high densities in suspension culture. 293 cells may include 293E cells. 293E cells are HEK293 cells stably expressing EBNA1 (Epstein-Barr virus nuclear antigen-1). In some cases, 293E cells may be grown in serum-free medium to simplify down-stream purification. In some cases, 293-6E cells (NRC Canada, Ottawa, CA) may be used. Such cells express truncated EBNA1 (EBNAlt) and may comprise enhanced production of recombinant proteins and may be optimized for growth and/or protein expression in serum-free medium to simplify down-stream purification. In some cases, insect cells may be used to express recombinant proteins of the invention. In some cases, insect cell expression may be carried out using *Spodoptera frugiperda* cells including, but not limited to Sf9 and/or Sf-21 cells. In some cases, insect cell cultures may comprise *Trichoplusia ni* cells, including, but not limited to Tn-368 and/or HIGH-FIVE™ BTI-TN-5B1-4 cells. A further list of exemplary insect cell lines can be found in U.S. Pat. No. 5,024,947, the contents of which are herein incorporated by reference in their entirety.

In some embodiments, recombinant proteins of the invention may comprise an antibody Fc domain to create an Fc fusion protein. The formation of an Fc fusion protein with any of the recombinant proteins described herein may be carried out according to any method known in the art, including as described in Czajkowsky, D. M. et al., 2012. EMBO Mol Med. 4(10):1015-28 and U.S. Pat. Nos. 5,116,964, 5,541,087 and 8,637,637, the contents of each of which are herein incorporated by reference in their entirety. Fc fusion proteins of the invention may be linked to the hinge region of an IgG Fc via cysteine residues in the Fc hinge region. Resulting Fc fusion proteins may comprise an antibody-like structure, but without Cm domains or light chains. In some cases, Fc fusion proteins may comprise pharmacokinetic profiles comparable to native antibodies. In some cases, Fc fusion proteins of the invention may comprise an extended half-life in circulation and/or altered biological activity. In some cases, Fc fusion proteins of the invention may be prepared using any of the TGF-β family proteins or TGF-β-related proteins described herein. In some cases, Fc fusion proteins may comprise TGF-β, GDF-8 and/or GDF-11.

Sequences encoding recombinant proteins of the present invention may be inserted into any number of DNA vectors known in the art for expression. Such vectors may include plasmids. In some embodiments, sequences encoding recombinant proteins of the present invention are cloned into pTT5 vectors (NRC Biotechnology Research Institute, Montreal, Québec.) In other embodiments pTT22, pTT28, pYD5, pYD7, pYD11(NRC Biotechnology Institute, Montreal, Québec) and/or pMA vectors (Life Technologies, Carlsbad, Calif.) may be used. Vectors may comprise promoter sequences to modulate expression of sequences encoding recombinant proteins of the present invention. Such promoters may be constitutively active and/or may be regulated by extrinsic and/or intrinsic factors. Some extrinsic factors may be used to enhance or suppress expression of sequences encoding recombinant proteins of the present invention. Some vectors may encode nuclear localization signals that may be incorporated into recombinant proteins of the present invention upon translation. Some vectors may produce mRNA transcripts that comprise nuclear export signals. RNA transcribed from a modified pTT5 vector (pTT5-WPRE) contains an element that facilitates nuclear export of the transcripts. Some vectors may be modified by insertion of one or more ligation-independent cloning (LIC) cassettes to provide for simpler cloning.

Vectors encoding recombinant proteins of the present invention may be delivered to cells according to any method known in the art, including, but not limited to transfection, electroporation and/or transduction. In some embodiments, vectors may comprise one or more elements to enhance vector replication in host cells. In some embodiments, vectors may comprise oriP sites for episomal replication in cells that express EBNA-1.

In some cases, cells are stably transfected to produce recombinant proteins of the present invention. Stably transfected cells pass transfected genes to daughter cells during cell division, thus eliminating the need for repeated transfection. In some cases, the transfected genes are stably inserted into the genome of the transfected cells. Transfected genes may comprise genes for cell selection, such as genes that confer resistance to one or more toxic or repressive compounds. Such genes may be used to support the growth of only cells with stable incorporation of the transfected genes when grown in the presence of such one or more toxic or repressive compounds (e.g. puromycin, kenomycin, etc.) Cell selection may also comprise selecting cells based on overall recombinant protein expression levels. Determination of such levels may be carried out, for example, by Western Blot and/or ELISA.

In some embodiments, nucleotide sequences encoding recombinant proteins of the present invention may comprise one or more woodchuck hepatitis virus posttranscriptional regulatory element (WPRE). RNA nucleic acids comprising such elements may comprise the sequence GCCACGGCG-GAACUCAUCGCCGCCUGCCUUGCCCGCUGCUG-GACAGGGGCUCGGC UGUUGGGCACUGACAAUUC-CGUGGU (SEQ ID NO: 255). RNA comprising WPREs may be transcribed from DNA comprising the sequence AAT-CAACCTCTGGATTACAAAATTTGTGAAAGATT-GACTGGTATTCTTAACTATGTT GCTCCTTTTACGC-TATGTGGATACGCTGCTTTAATGCCTTTGTATCAT-GCTATTGCTT CCCGTATGGCTTTCATTTTCTCCTC-CTTGTATAAATCCTGGTTGCTGTCTCTTTATGAG GAGTTGTGGCCCGTTGTCAGGCAACGTG-GCGTGGTGTGCACTGTGTTTGCTGACGCA ACCCCCACTGGTTGGGGCATTGCCAC-CACCTGTCAGCTCCTTTCCGGGACTTTCGCTT TCCCCCTCCCTATTGCCACGGCGGAACT-CATCGCCGCCTGCCTTGCCCGCTGCTGGA CAGGGGCTCGGCTGTTGGGCACTGA-CAATTCCGTGGTGTTGTCGGGGAAGCTGACGT CCTTTCCATGGCTGCTCGCCTGTGTTGC-CACCTGGATTCTGCGCGGGACGTCCTTCTG CTACGTCCCTTCGGCCCTCAATCCAGCG-GACCTTCCTTCCCGCGGCCTGCTGCCGGCT CTGCG-GCCTCTTCCGCGTCTTCGCCTTCGCCCT-CAGACGAGTCGGATCTCCCTTTGGG CCGCCTCCCCGCCTG (SEQ ID NO: 256). WPREs may enhance translation of nucleic acids comprising WPREs. Such enhanced translation may be due to increased cytoplasmic export of newly transcribed mRNA.

In some embodiments, recombinant proteins may comprise one or more secretion signal sequences. As used herein, the term "secretion signal sequence" refers to a chain of amino acids (or nucleotides that encode them at the nucleic acid level) that when part of a protein, modulate secretion of such proteins from cells. Some secretion signal sequences may be located at protein termini. In other embodiments, secretion signal sequences may be N-terminal amino acid sequences. Other secretions signal sequences may comprise the secretion signal of the Ig kappa chains. Such Ig kappa chains may be human Ig kappa chains. In some embodiments, secretion signal sequences may comprise the amino acid sequence MDMRVPAQLLGLLLLWFSGVLG (SEQ ID NO: 257).

In some embodiments, recombinant proteins of the present invention may require coexpression with one or more other proteins for proper expression, folding, secretion, activity and/or function. Some recombinant GPCs of the present invention may be coexpressed with LTBPs, fibrillins and/or GARP.

In some embodiments, recombinant proteins of the present invention may be biotinylated. As used herein, the term "biotinylating" refers to the attaching of one or more biotin labels. Such biotin labels may facilitate interactions of biotinylated recombinant proteins with avidin and/or streptavidin coated surfaces and/or proteins. As used herein, a "biotin label" refers to a detectable label comprising one or more biotin molecules. The term "biotinylated" refers to a molecule or protein that comprises one or more biotin labels. Biotin molecules bind with high affinity to avidin and streptavidin molecules. This property may be used to capture biotinylated proteins using avidin and/or stretavidin coated materials. Some recombinant GPCs of the present invention may be biotinylated near the N-terminus. Such recombinant GPCs may be introduced to avidin/streptavidin coated cell culture surfaces, allowing biotinylated recombinant GPCs to adhere to the surface in a manner such that the orientation and bonding of such bound GPCs mimics the orientation and bonding of GPCs to LTBPs, fibrillins and/or GARPs.

In some embodiments, recombinant proteins produced may be analyzed for quality control purposes to assess both biophysical properties as well as bioactive properties. Biophysical characterization may include assessing protein migration patterns after reducing and/or non-reducing SDS PAGE. Biophysical characterization may also comprise gel filtration, mass spectrometric analysis and/or analysis of association/dissociation between LAPs or LAP-like domains and growth factor domains. Bioactive properties may be analyzed by assessing reactivity with antibodies and/or signaling activity of dissociated growth factors and/or latent GPCs.

Some proteins produced may comprise additional amino acids encoding one or more detectable labels for purification [e.g. polyhistidine tag, flag tag, etc.] In some embodiments, proteins are N-terminally labeled. In some embodiments, proteins are C-terminally labeled. In some embodiments, proteins are biotinylated. In some embodiments, recombinant proteins of the present invention are N-terminally biotinylated.

Proteins produced may comprise additional amino acids encoding one or more 3C protease cleavage site. Such sites allow for cleavage between residues Q and G of the 3C protease cleavage site upon treatment with 3C protease, including, but not limited to rhinovirus 3C protease. In some embodiments, such cleavage sites are introduced to allow for removal of detectable labels from recombinant proteins.

In some embodiments, modification of expressed growth factor proproteins may be carried out by enzymatic cleavage. In some cases, proprotein convertases may be used. Such proprotein convertases may include, but are not limited to furin/PACE3, PC1/3, PC2, PC4, PC5/6, PACE4 and PC7. Proprotein convertase cleavage may be carried out in solution or in tissue culture. In some cases, proprotein convertases are expressed in cells expressing proproteins to be cleaved. In some cases, proprotein convertases are added to tissue cultures of cells expressing proproteins to be cleaved.

Antibodies

In some embodiments, compounds and/or compositions of the present invention may comprise antibodies or fragments thereof. As used herein, the term "antibody" is referred to in the broadest sense and specifically covers various embodiments including, but not limited to monoclonal antibodies, polyclonal antibodies, multispecific antibodies (e.g. bispecific antibodies formed from at least two intact antibodies), and antibody fragments such as diabodies so long as they exhibit a desired biological activity. Antibodies are primarily amino-acid based molecules but may also comprise one or more modifications (including, but not limited to the addition of sugar moieties, fluorescent moieties, chemical tags, etc.)

Recombinant and Chimeric Protein Use in Antibody Generation

In some embodiments, recombinant and/or chimeric proteins described herein may be used as antigens (referred to herein as antigenic proteins) to generate antibodies. Such antigenic proteins may comprise epitopes that may be less accessible for antibody generation in similar wild type proteins. Some antibodies directed to antigenic proteins of the present invention may modulate the release of one or more growth factors from one or more GPCs.) Some such antibodies may be stabilizing [reducing or preventing dissociation between two agents, (e.g. growth-factor release from GPCs, GPC release from one or more protein interactions)] and/or releasing [enhancing the dissociation between two agents (e.g. growth-factor release from GPCs, GPC release from one or more protein interactions)] antibodies. Antigenic proteins of the present invention may comprise TGF-β-related proteins as well as components and/or protein modules thereof. In some cases, antigenic proteins of the present invention may comprise prodomains without associated growth factors, furin cleavage-deficient mutants, mutants deficient in extracellular protein associations and/or combinations thereof.

In some embodiments, antigenic proteins may comprise TGF-β-related proteins and/or modules thereof. Such antigenic proteins may comprise epitopes from regions where growth factors associate with or comprise stereological proximity with prodomain regions. Antibodies of the present invention directed to such epitopes may bind overlapping regions between growth factors and prodomains. Such antibodies may stereologically inhibit the dissociation of growth factors from GPCs.

In some embodiments, antigenic proteins comprise only the prodomain or only the growth factor from a particular GPC. Epitopes present on such antigenic proteins may be shielded or unexposed in intact GPCs. Some antibodies of the present invention may be directed to such epitopes. Such antibodies may be releasing antibodies, promoting growth factor dissociation from GPCs. Further antibodies may compete with free growth factor for prodomain binding, thereby promoting growth factor dissociation from GPCs.

In some embodiments, antigenic proteins may comprise proprotein convertase (e.g. furin) cleavage site mutations. Such mutations may prevent enzymatic cleavage of growth factors from their prodomains. Some antibodies of the present invention may be directed to epitopes present on such mutant proteins. Such antibodies may stabilize the association between prodomains and growth factors. In some embodiments, furin cleavage site mutants comprise D2G mutants as described herein.

In some embodiments, antigenic proteins comprising prodomains may comprise N-terminal mutations that lead to decreased prodomain association with LTBPs and/or GARP and therefore may present epitopes in the N-terminal region that may otherwise be shielded by those associations. Some antibodies of the present invention may be directed to such epitopes. Some antigenic proteins comprising TGF-β1 prodomains may comprise C4S mutations. Such mutations may prevent association of antigenic proteins with LTBPs and/or GARP, making these proteins useful for presenting N-terminal epitopes. Antibodies directed to C4S mutants may prevent GPC association with LTBPs and/or GARP. Some antibodies directed to C4S mutants may reduce growth factor signaling in a particular niche. Some such antibodies may reduce or prevent the release of growth factor by blocking the ability of the GPCs to associate securely with the extracellular matrix.

In some embodiments, antigenic proteins may comprise one or more recombinant LTBP. Such recombinant LTBPs may comprise LTBP1, LTBP2, LTBP3, LTBP4, alternatively spliced variants and/or fragments thereof. Recombinant LTBPs may also be modified to comprise one or more detectable labels. Such detectable labels may include, but are not limited to biotin labels, polyhistidine tags, myc tags, HA tags and/or fluorescent tags.

In some embodiments, antigenic proteins may comprise one or more recombinant protein and/or chimeric protein complexed with one or more recombinant LTBP. Some antigenic proteins may comprise proprotein convertase cleavage site mutants (e.g. D2G mutants, AXXA mutants) complexed with one or more recombinant LTBP. Some such recombinant LTBPs may comprise LTBP1 S. Some recombinant LTBPs may comprise one or more detectable labels, including, but not limited to biotin labels, polyhistidine tags and/or flag tags.

In some embodiments, antigenic proteins may comprise GARP (or homologues thereof, including, but not limited to LRRC33). Such GARP may be recombinant, referred to herein as recombinant GARP. Some recombinant GARPs may comprise one or more modifications, truncations and/or mutations as compared to wild type GARP. Recombinant GARPs may be modified to be soluble. In other embodiments, recombinant GARPs are modified to comprise one or more detectable labels. In further embodiments, such detectable labels may include, but are not limited to biotin labels, polyhistidine tags, flag tags, myc tags, HA tags and/or fluorescent tags. In some embodiments, antigenic proteins may comprise one or more recombinant protein and/or chimeric protein complexed with one or more recombinant GARP. In some embodiments, antigenic proteins comprise LAPs (e.g. TGF-β LAPs) and/or LAP-like domains complexed with recombinant GARP. In some embodiments, antigenic proteins comprise D2G mutants (e.g. TGF-β D2G mutants) complexed with recombinant GARP. In some embodiments, complexed recombinant GARPs may be soluble forms of GARP (sGARP). In some embodiments, sGARPs comprises one or more biotin labels, polyhistidine tags and/or flag tags.

In some embodiments, GARPs complexed with LAP and/or LAP-like domains are desired as antigens, in assays and/or for antibody development. In such embodiments, LAPs and/or LAP-like domains may comprise CED mutations. Such LAPs and/or LAP-like domains may be expressed as GPCs to facilitate proper protein folding, conformation and/or expression, but the CED mutations present may enhance growth factor release, leaving the desired GARP-LAP (or LAP-like domain) complex behind. GARP-LAP (or LAP-like domain) complexes may be useful as antigens in the production of releasing antibodies that specifically target GARP-associated GPCs.

In some embodiments, GPCs comprising CED mutations may act to stabilize a natively populated conformation of LAP (or LAP-like domain) characterized by reduced growth factor association (both as a free LAP or LAP-like domains and/or as a GARP and/or LTBP/LAP complex), thereby exposing epitopes that may be less exposed in wild-type proteins. Such mutations may shift the conformational equilibrium of LAP or LAP-like domains to facilitate the production of activating antibodies.

In some embodiments, antigenic proteins of the present invention may comprise one or more protein modules from GDFs (e.g. GDF-11 and/or GDF-8). In some embodiments, antibodies of the present invention may be directed toward antigenic proteins comprising GDF-8 protein modules. In some embodiments, such antibodies may modulate GDF-8 levels and/or activity in one or more niches. In some embodiments, antibodies of the present invention may prevent the release of GDF-8 growth factors from GPCs. In some embodiments, antibodies of the present invention may be used to repair and/or enhance muscle tissues.

In some embodiments, recombinant proteins (including, but not limited to chimeric proteins) described herein may be used in studies to identify and map epitopes that may be important targets for antibody development. Such studies may be used to identify epitopes that may promote growth factor release or stabilization of GPCs upon antibody binding.

Releasing Antibodies

As used herein, the term "releasing antibody" refers to an antibody that increases the ratio of active and/or free growth factor relative to inactive and/or prodomain-associated growth factor upon the introduction of the antibody to a GPC, cell, niche, natural depot or any other site of growth factor sequestration. In this context, releasing antibodies may be characterized as agonists. As used herein, the term "natural depot" refers to a location within a cell, tissue or organ where increased levels of a biomolecule or ion are stored. For example, the extracellular matrix may act as a natural depot for one or more growth factors.

The contact necessary for growth-factor release may be defined as direct or indirect contact of antibody with a GPC or a component thereof or with a cellular structure such as an extracellular and/or cellular matrix protein and/or protein associated with the extracellular and/or cellular matrix [e.g. LTBPs (e.g. LTBP1, LTBP2, LTBP3 and/or LTBP4), fibrillins (e.g. fibrillin-1, fibrillin-2, fibrillin-3 and/or fibrillin-4,) perlecan, decorin, elastin, collagen and/or GARPs (e.g. GARP and/or LRRC33)] for release of growth factor. Release of at least 5%, 10%, 20%, 30%, 40%, 50%, 60%, 70%, 80%, 90% or more of growth factor is sufficient to characterize antibodies of the present invention as releasing antibodies. It is understood that growth factor release after antibody administration may be local and may occur over a sustained period of time and may include peaks or spikes of release. Antibodies of the present invention may act to release one or more growth factor over minutes, hours, days or longer.

Release profiles may have an initial peak or burst within from about 4 hours to about 7 days of contacting in vivo or shorter periods in vitro. For example, initial peak or burst may occur from about 4 hours to about 5 hours, or from about 4 hours to about 6 hours, or from about 4 hours to about 7 hours, or from about 4 hours to about 8 hours, or from about 4 hours to about 9 hours, or from about 4 hours to about 10 hours, or from about 4 hours to about 11 hours, or from about 4 hours to about 12 hours, or from about 4 hours to about 24 hours, or from about 4 hours to about 36 hours, or from about 4 hours to about 48 hours, or from about 1 day to about 7 days, or from about 1 day to about 2 days, or from about 1 day to about 3 days, or from about 1 day to about 4 days, or from about 4 days to about 5 days, or from about 4 days to about 6 days, or from about 4 days to about 7 days. Compounds and/or compositions of the present invention may stimulate the release of 5 to 100% of the growth factor present. For example, the percent of growth factor release may be from about 5% to about 10%, or from about 5% to about 15%, or from about 5% to about 20%, or from about 5% to about 25%, or from about 10% to about 30%, or from about 10% to about 40%, or from about 10% to about 50%, or from about 10% to about 60%, or from about 20% to about 70%, or from about 20% to about 80%, or from about 40% to about 90%, or from about 40% to about 100%.

Releasing antibodies generated according to methods described herein may be generated to release growth factors from GPCs comprising any of the pro-proteins listed in Table 1. In some cases, releasing antibodies are directed to GPCs comprising TGF-β isoforms and/or one or more modules of such isoforms. In some cases, releasing antibodies are directed to GPCs comprising GDFs and/or one or more modules from GDFs.

Stabilizing Antibodies

As used herein, the term "stabilizing antibody" refers to an antibody that decreases the ratio of active and/or free growth factor relative to inactive and/or prodomain-associated growth factor upon the introduction of the antibody to one or more GPC, cell, niche, natural depot and/or any other site of growth factor sequestration. In this context, antibodies may be characterized as antagonists. As used herein, an "antagonist" is one which interferes with or inhibits the physiological action of another. Antagonist action may even result in stimulation or activation of signaling downstream and hence may act agonistically relative to another pathway, separate from the one being antagonized. Pathways are interrelated, so, in one nonlimiting example, a TGF-β antagonist could act as a BMP agonist and vice versa. In the context of cellular events, as used herein, the term "downstream" refers to any signaling or cellular event that happens after the action, binding or targeting by compounds and/or compositions of the present invention.

Contact necessary for inhibition or stabilization may be direct or indirect contact between antibody and GPC or components thereof or with cellular structures such as an extracellular and/or cellular matrix protein and/or protein associated with the extracellular and/or cellular matrix [e.g. LTBPs (e.g. LTBP1, LTBP2, LTBP3 and/or LTBP4), fibrillins (e.g. fibrillin-1, fibrillin-2, fibrillin-3 and/or fibrillin-4,) perlecan, decorin, elastin, collagen and/or GARPs (e.g. GARP and/or LRRC33)] whereby release of growth factor is inhibited Inhibition of release of at least 5%, 10%, 20%, 30%, 40%, 50%, 60%, 70%, 80%, 90% or more of growth factors may be sufficient, in some cases, to characterize antibodies of the present invention as inhibitory or stabilizing. Inhibitory antibodies may stabilize GPCs and trap them as heterodimers.

It is understood that inhibition of growth factor release after contact with one or more antibodies of the present invention may be local and may occur over a sustained period of time and may include peaks, troughs or spikes. Inhibitory antibodies which may also function to stabilize GPCs may be defined by their release kinetics. Release of growth factor and corresponding release kinetics, even locally, may be directly measured or inferred by downstream signaling events. In some embodiments, changes in protein or nucleic acid concentrations or phenotypic responses may be indicative of the effects of compounds and/or compositions of the present invention.

Antibodies of the present invention may act to inhibit release of a growth factor over minutes, hours or days Inhibition and/or stabilization profiles may have an initial trough within from about 4 hours to about 7 days of introduction in vivo or shorter periods in vitro. For example, initial trough of inhibition or stabilization may occur from about 4 hours to about 5 hours, or from about 4 hours to about 6 hours, or from about 4 hours to about 7 hours, or from about 4 hours to about 8 hours, or from about 4 hours to about 9 hours, or from about 4 hours to about 10 hours, or from about 4 hours to about 11 hours, or from about 4 hours to about 12 hours, or from about 4 hours to about 24 hours, or from about 4 hours to about 36 hours, or from about 4 hours to about 48 hours, or from about 1 day to about 7 days, or from about 1 day to about 2 days, or from about 1 day to about 3 days, or from about 1 day to about 4 days, or from about 4 days to about 5 days, or from about 4 days to about 6 days, or from about 4 days to about 7 days. Introduction of compounds and/or compositions of the present invention may lead to inhibition and/or stabilization of 5% to 100% of growth factor present. For example, the percent of growth factor inhibition or stabilization may be from about 5% to about 10%, from about 5% to about 15%, from about 5% to about 20%, from about 5% to about 25%, from about 10% to about 30%, from about 10% to about 40%, from about 10% to about 50%, from about 10% to about 60%, from about 20% to about 70%, from about 20% to about 80%, from about 40% to about 90% or from about 40% to about 100%.

Stabilizing antibodies generated according to methods described herein may be generated to block the release of growth factors from GPCs comprising any of the pro-proteins listed in Table 1. Such antibodies may physically interact with GPC protease cleavage sites and/or block the interaction of proteolytic enzymes that may target such cleavage sites. In some cases, stabilizing antibodies are directed to GPCs comprising TGF-β isoforms and/or one or more modules of such isoforms. In some cases, stabilizing antibodies are directed to GPCs comprising GDFs and/or one or more modules from GDFs.

Stabilizing antibodies directed to GPCs comprising GDF-8 may block metalloproteinase cleavage of such complexes. Such agents may bind to GPCs comprising GDF-8 in such a way as to physically prevent interactions between such GPCs and metalloproteinases targeting such GPCs. Agents that actually target metalloproteinases themselves have been described previously (see U.S. Pat. No. 7,572,599, the contents of which are herein incorporated by reference in their entirety.)

Antibody Selection

A desired antibody may be selected from a larger pool of two or more candidate antibodies based on the desired antibody's ability to associate with desired antigens and/or epitopes. Such antigens and/or epitopes may include, but are not limited to any of those described herein, including, but not limited to recombinant proteins, chimeric proteins, GPCs, prodomains (e.g. LAPs or LAP-like domains), growth factors, protein modules, LTBPs, fibrillins, GARP, TGF-β-related proteins and/or mutants and/or variants and/or complexes and/or combinations thereof. Selection of desired antibodies may be carried out using an antibody binding assay, such as a surface Plasmon resonance-based assay, an enzyme-linked immunosorbent assay (ELISA) or fluorescence-associated cell sorting (FACS)-based assay. Such assays may utilize a desired antigen to bind a desired antibody and then use one or more detection methods to detect binding.

In some embodiments, antibodies of the present invention may be selected from a larger pool of two or more candidate antibodies based on their ability to associate with desired antigens and/or epitopes from multiple species (referred to herein as "positive selection.")

In some embodiments, such species may comprise vertebrate species. In some embodiments, such species may comprise mammalian species. In some embodiments, such species may include, but are not limited to mice, rats, rabbits, goats, sheep, pigs, horses, cows and/or humans.

In some embodiments, negative selection is used to remove antibodies from a larger pool of two or more candidate antibodies. As used herein the term "negative selection" refers to the elimination of one or more factors from a group based on their ability to bind to one or more undesired antigens and/or epitopes. In some embodiments, undesired antigens and/or epitopes may include, but are not limited to any of those described herein, including, but not limited to recombinant proteins, chimeric proteins, GPCs, prodomains (e.g. LAPs or LAP-like domains), growth factors, protein modules, LTBPs, fibrillins, GARPs, TGF-β-related proteins and/or mutants and/or variants and/or combinations and/or complexes thereof.

In some embodiments, antibodies of the present invention may be directed to prodomains (e.g. the prodomain portion of a GPC and/or free LAP or LAP-like domains) that decrease growth factor signaling and/or levels (e.g. TGF-β growth factor signaling and/or levels) in a given niche. In some embodiments, antibodies of the present invention may directed to LAPs or LAP-like domains that increase growth factor signaling and/or levels in a given niche. In some embodiments, antibodies of the present invention may be directed to prodomains (e.g. LAPs or LAP-like domains) and/or GPCs only when complexed with LTBPs, fibrillins and/or GARP.

In some embodiments, antibodies of the present invention may be selected from a larger pool of two or more candidate antibodies based on their ability to modulate growth factor levels and/or activity. In some cases, growth factor activity assays may be used to test the ability of candidate antibodies to modulate growth factor activity. Growth factor activity assays may include, cell-based assays as described hereinbelow. Additional assays that may be used to determine the effect of candidate antibodies on growth factor activity may include, but are not limited to enzyme-linked immunosorbent assay (ELISA), Western blotting, reporter assays (e.g. luciferase-based reporter assays or other enzyme-based reporter assays), PCR analysis, RT-PCR analysis and/or other methods known in the art including any of the methods described in U.S. Provisional Patent Applications 61/722,919, filed Nov. 6, 2012 and 61/722,969, filed Nov. 6, 2012, the contents of each of which are herein incorporated by reference in their entireties.

In some embodiments, one or more recombinant proteins or antibodies disclosed herein may be used in assays to test, develop and/or select antibodies. Recombinant GPCs may be expressed to test releasing and/or stabilizing abilities of one or more antibodies being assayed. In some embodiments, recombinant proteins may be expressed as positive or negative control components of assays. In some embodiments, multiple recombinant proteins may be expressed at once to modulate growth factor release and/or activity, wherein such recombinant proteins may act synergistically or antagonistically in such modulation.

In some embodiments GPCs comprising CED mutations may provide a baseline level of growth factor activity in assays designed to test releasing antibodies, as these mutant proteins are sufficient for producing a biological effect in humans. In some embodiments, GPCs comprising CED mutations may be used as positive controls in activity assays geared toward screening for releasing antibodies. In some embodiments, GPCs comprising CED mutations may be used for screening for stabilizing antibody activity, as they can be presumably activated in the absence of integrins. In such assays, GPCs comprising CED mutations may be expressed in cell lines (e.g. 293 cells or others) and growth factor activity and/or release may be assessed in the presence or absence of antibodies being tested. In some embodiments, co-expression of GPCs comprising CED mutation with wild type GPCs (including, but not limited to TGF-β1, TGF-β2, or TGF-β3) could also be used to regulate free growth factor levels. In such embodiments, modulation of free growth factor levels may accomplished by co-transfection of different ratios of wild type and mutant GPCs (e.g. 1:1, 1:2, 1:3, 1:4, 1:5, 1:10). In some embodiments, further co-expression of LTBPs, fibrillins or GARPs may be carried out to add one or more additional levels of free growth factor modulation.

Antibody Development

In some embodiments, compounds and/or compositions of the present invention comprising antibodies, antibody fragments, their variants or derivatives as described above are specifically immunoreactive with antigenic proteins as described herein.

Antibodies of the present invention may be characterized by their target molecule(s), by the antigens used to generate them, by their function (whether as agonists, antagonists, growth-factor releasing, GPC stabilizing, activating and/or inhibitory) and/or by the cell niche in which they function.

As used herein the term, "antibody fragment" refers to any portion of an intact antibody. In some embodiments, antibody fragments comprise antigen binding regions from intact antibodies. Examples of antibody fragments may include, but are not limited to Fab, Fab', F(ab')2, and Fv fragments; diabodies; linear antibodies; single-chain antibody molecules; and multispecific antibodies formed from antibody fragments. Papain digestion of antibodies produces two identical antigen-binding fragments, called "Fab" fragments, each with a single antigen-binding site. Also produced is a residual "Fc" fragment, whose name reflects its ability to crystallize readily. Pepsin treatment yields an F(ab')2 fragment that has two antigen-binding sites and is still capable of cross-linking antigen. Compounds and/or compositions of the present invention may comprise one or more of these fragments. For the purposes herein, an "antibody" may comprise a heavy and light variable domain as well as an Fc region.

As used herein, the term "native antibody" refers to a usually heterotetrameric glycoprotein of about 150,000 daltons, composed of two identical light (L) chains and two identical heavy (H) chains. Each light chain is linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain ($V_H$) followed by a number of constant domains. Each light chain has a variable domain at one end ($V_L$) and a constant domain at its other end; the constant domain of the light chain is aligned with the first constant domain of the heavy chain, and the light chain variable domain is aligned with the variable domain of the heavy chain.

As used herein, the term "variable domain" refers to specific antibody domains that differ extensively in sequence among antibodies and are used in the binding and specificity of each particular antibody for its particular antigen.

As used herein, the term "Fv" refers to antibody fragments comprising complete antigen-recognition and antigen-binding sites. These regions consist of a dimer of one heavy chain and one light chain variable domain in tight, non-covalent association.

As used herein, the term "light chain" refers to a component of an antibody from any vertebrate species assigned to one of two clearly distinct types, called kappa and lambda based on amino acid sequences of constant domains. Depending on the amino acid sequence of the constant domain of their heavy chains, antibodies can be assigned to different classes. There are five major classes of intact antibodies: IgA, IgD, IgE, IgG, and IgM, and several of these may be further divided into subclasses (isotypes), e.g., IgG1, IgG2, IgG3, IgG4, IgA, and IgA2.

As used herein, the term "Single-chain Fv" or "scFv" refers to a fusion protein of $V_H$ and $V_L$ antibody domains, wherein these domains are linked together into a single polypeptide chain. In some embodiments, the Fv polypeptide linker enables the scFv to form the desired structure for antigen binding.

As used herein, the term "bispecific antibody" refers to an antibody capable of binding two different antigens. Such antibodies typically comprise regions from at least two different antibodies. Bispecific antibodies may include any of those described in Riethmuller, G. 2012. Cancer Immunity. 12:12-18, Marvin, J. S. et al., 2005. Acta Pharmacologica Sinica. 26(6):649-58 and Schaefer, W. et al., 2011. PNAS. 108(27):11187-92, the contents of each of which are herein incorporated by reference in their entirety.

As used herein, the term "diabody" refers to a small antibody fragment with two antigen-binding sites. Diabodies comprise a heavy chain variable domain $V_H$ connected to a light chain variable domain $V_L$ in the same polypeptide chain. By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al. (Hollinger, P. et al., "Diabodies": Small bivalent and bispecific antibody fragments. PNAS. 1993. 90:6444-8) the contents of each of which are incorporated herein by reference in their entirety.

As used herein, the term "monoclonal antibody" refers to an antibody obtained from a population of substantially homogeneous cells (or clones), i.e., the individual antibodies comprising the population are identical and/or bind the same epitope, except for possible variants that may arise during production of the monoclonal antibodies, such variants generally being present in minor amounts. In contrast to polyclonal antibody preparations that typically include different antibodies directed against different determinants (epitopes), each monoclonal antibody is directed against a single determinant on the antigen The modifier "monoclonal" indicates the character of the antibody as being obtained from a substantially homogeneous population of antibodies, and is not to be construed as requiring production of the antibody by any particular method. The monoclonal antibodies herein include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies.

As used herein, the term "humanized antibody" refers to a chimeric antibody comprising a minimal portion from one or more non-human (e.g., murine) antibody source with the remainder derived from one or more human immunoglobulin sources. For the most part, humanized antibodies are human immunoglobulins (recipient antibody) in which residues from the hypervariable region from an antibody of the recipient are replaced by residues from the hypervariable region from an antibody of a non-human species (donor antibody) such as mouse, rat, rabbit or nonhuman primate having the desired specificity, affinity, and/or capacity.

As used herein, the term "hypervariable region" refers to regions within the antigen binding domain of an antibody comprising amino acid residues responsible for antigen binding. The amino acids present within the hypervariable regions determine the structure of the complementarity determining region (CDR). As used herein, the term "CDR" refers to regions of antibodies comprising a structure that is complimentary to its target antigen or epitope.

In some embodiments, compounds and/or compositions of the present invention may be antibody mimetics. As used herein, the term "antibody mimetic" refers to any molecule which mimics the function or effect of an antibody and which binds specifically and with high affinity to their molecular targets. In some embodiments, antibody mimetics may be monobodies, designed to incorporate the fibronectin type III domain (Fn3) as a protein scaffold (U.S. Pat. No. 6,673,901; U.S. Pat. No. 6,348,584). In some embodiments, antibody mimetics may be those known in the art including, but are not limited to affibody molecules, affilins, affitins, anticalins, avimers, Centyrins, DARPINS™, Fynomers and Kunitz and domain peptides. In other embodiments, antibody mimetics may include one or more non-peptide region.

As used herein, the term "antibody variant" refers to a biomolecule resembling an antibody in structure and/or function comprising some differences in their amino acid sequence, composition or structure as compared to a native antibody.

The preparation of antibodies, whether monoclonal or polyclonal, is known in the art. Techniques for the production of antibodies are well known in the art and described, e.g. in Harlow and Lane "Antibodies, A Laboratory Manual", Cold Spring Harbor Laboratory Press, 1988; Harlow and Lane "Using Antibodies: A Laboratory Manual" Cold Spring Harbor Laboratory Press, 1999 and "Therapeutic Antibody Engineering: Current and Future Advances Driving the Strongest Growth Area in the Pharmaceutical Industry" Woodhead Publishing, 2012.

Standard Monoclonal Antibody Generation

In some embodiments, antibodies are generated in knockout mice, lacking the gene that encodes for desired target antigens. Such mice may not be tolerized to target antigens and therefore may be better suited for generating antibodies against such antigens that may cross react with human and mouse forms of the antigen. For the production of monoclonal antibodies, host mice may be immunized with recombinant proteins to elicit lymphocytes that specifically bind such proteins. Resulting lymphocytes may be collected and fused with immortalized cell lines. Resulting hybridoma cells may be cultured in suitable culture medium with selection agents to support the growth of only fused cells.

Desired hybridoma cell lines may be identified through binding specificity analysis of secreted antibodies for target peptides and clones of such cells may be subcloned through limiting dilution procedures and grown by standard methods. Antibodies produced by subcloned hybridoma cells may be isolated and purified from culture medium by standard immunoglobulin purification procedures Recombinant Antibodies Recombinant antibodies of the present invention may be generated according to any of the methods disclosed in U.S. Provisional Patent Applications 61/722,919, filed Nov. 6, 2012 and 61/722,969, filed Nov. 6, 2012, the contents of each of which are herein incorporated by reference in their entireties. In some embodiments, recombinant antibodies may be produced using hybridoma cells produced according to methods described herein. Heavy and light chain variable region cDNA sequences of antibodies may be determined using standard biochemical techniques. Total RNA may be extracted from antibody-producing hybridoma cells and converted to cDNA by reverse transcriptase (RT) polymerase chain reaction (PCR). PCR amplification may be carried out on resulting cDNA to amplify variable region genes. Such amplification may comprise the use of primers specific for amplification of heavy and light chain sequences. Resulting PCR products may then be subcloned into plasmids for sequence analysis. Once sequenced, antibody coding sequences may be placed into expression vectors. For humanization, coding sequences for human heavy and light chain constant domains may be used to substitute for homologous murine sequences. The resulting constructs may then be transfected into mammalian cells for large scale translation.

Development of Cytotoxic Antibodies

In some embodiments, antibodies of the present invention may be capable of inducing antibody-dependent cell-mediated cytotoxicity (ADCC), complement-dependent cytotoxicity (CDC) and/or antibody-dependent cell phagocytosis (ADCP.) ADCC is an immune mechanism whereby cells are lysed as a result of immune cell attack. Such immune cells may include CD56+ cells, CD3− natural killer (NK) cells, monocytes and neutrophils (Strohl, W. R. Therapeutic Antibody Engineering. Woodhead Publishing, Philadelphia Pa.

2012. Ch. 8, p 186, the contents of which are herein incorporated by reference in their entirety.)

In some cases, antibodies of the present invention may be engineered to comprise a given isotype depending on whether or not ADCC or ADCP is desired upon antibody binding. Such antibodies, for example, may be engineered according to any of the methods disclosed by Alderson, K. L. et al., J Biomed Biotechnol. 2011. 2011:379123.) In the case of mouse antibodies, different isotypes of antibodies are more effective at promoting ADCC. IgG2a, for example, is more effective at inducing ADCC than is IgG2b. Some antibodies of the present invention, comprising mouse IgG2b antibodies may be reengineered to comprise IgG2a antibodies. Such reengineered antibodies may be more effective at inducing ADCC upon binding cell-associated antigens.

In some embodiments, genes encoding variable regions of antibodies developed according to methods of the present invention may be cloned into mammalian expression vectors encoding human Fc regions. Such Fc regions may comprise Fc regions from human IgG1κ. IgG1κ Fc regions may comprise amino acid mutations known to enhance Fc-receptor binding and antibody-dependent cell-mediated cytotoxicity ADCC.

In some cases, antibodies may be engineered to reduce ADCC. Antibodies that do not activate ADCC or that are associated with reduced levels of ADCC may be desirable for antibody embodiments of the present invention, in some cases due to no or limited immune-mediated clearance, allowing longer half-lives in circulation.

Antibody Fragment Display Library Screening Techniques

In some embodiments, antibodies of the present invention may be produced and/or optimized using high throughput methods of discovery. Such methods may include any of the display techniques (e.g. display library screening techniques) disclosed in U.S. Provisional Patent Applications 61/722,919, filed Nov. 6, 2012 and 61/722,969, filed Nov. 6, 2012, the contents of each of which are herein incorporated by reference in their entireties. In some embodiments, synthetic antibodies may be designed, selected or optimized by screening target antigens using display technologies (e.g. phage display technologies.) Phage display libraries may comprise millions to billions of phage particles, each expressing unique antibody fragments on their viral coats. In some cases, cDNA encoding each fragment may contain the same sequence with the exception of unique sequences encoding variable loops of the complementarity determining regions (CDRs). $V_H$ chains of CDRs may be expressed as a fusion protein, linked to viral coat proteins (e.g. the N-terminus of the viral pIII coat protein.) $V_L$ chains may be expressed separately for assembly with $V_H$ chains in the periplasm prior to complex incorporation into viral coats.

For selection, target antigens may be incubated, in vitro, with phage display library particles for precipitation of positive binding partners. This process is referred to herein as "phage enrichment." In some cases, phage enrichment comprises solid-phase phage enrichment. According to such enrichment, target antigens are bound to a substrate (e.g. by passive adsorption) and contacted with one or more solutions comprising phage particles. Phage particles with affinity for such target antigens are precipitated out of solution. In some cases, phage enrichment comprises solution-phase phage enrichment where target antigens are present in a solution that is combined with phage solutions. According to such methods, target antigens may comprise detectable labels (e.g. biotin labels) to facilitate retrieval from solution and recovery of bound phage.

After selection, cDNA encoding CDRs of precipitated library members may be sequenced from the bound phage. Such sequences may be directly incorporated into antibody sequences for recombinant antibody production, or mutated and utilized for further optimization through in vitro affinity maturation.

In some cases phage display screening may be used to generate broadly diverse panels of antibodies. Such diversity may be measured by diversity of antibody sequences and/or diversity of epitopes targeted.

Affinity Maturation Techniques

Affinity maturation techniques of the present invention may comprise any of those disclosed in U.S. Provisional Patent Applications 61/722,919, filed Nov. 6, 2012 and 61/722,969, filed Nov. 6, 2012, the contents of each of which are herein incorporated by reference in their entireties. After antibody fragments capable of binding target antigens are identified (e.g. through the use of phage display libraries as described above,) high affinity mutants may be derived from these through the process of affinity maturation. Affinity maturation technology is used to identify sequences encoding CDRs that have the highest affinity for target antigens. Using such technologies, select CDR sequences (e.g. ones that have been isolated or produced according to processes described herein) may be mutated randomly as a whole or at specific residues to create millions to billions of variants. Such variants may be subjected to repeated rounds of affinity screening (e.g. display library screening) for their ability to bind target antigens. Such repeated rounds of selection, mutation and expression may be carried out to identify antibody fragment sequences with the highest affinity for target antigens. Such sequences may be directly incorporated into antibody sequences for recombinant antibody production.

Antibody Characterization

Compounds and/or compositions of the present invention comprising antibodies may act to decrease local concentration of one or more GPC through removal by phagocytosis, pinocytosis, or inhibiting assembly in the extracellular matrix and/or cellular matrix. Introduction of compounds and/or compositions of the present invention may lead to the removal of 5% to 100% of the growth factor present in a given area. For example, the percent of growth factor removal may be from about 5% to about 10%, from about 5% to about 15%, from about 5% to about 20%, from about 5% to about 25%, from about 10% to about 30%, from about 10% to about 40%, from about 10% to about 50%, from about 10% to about 60%, from about 20% to about 70%, from about 20% to about 80%, from about 40% to about 90% or from about 40% to about 100%.

Measures of release, inhibition or removal of one or more growth factors may be made relative to a standard or to the natural release or activity of growth factor under normal physiologic conditions, in vitro or in vivo. Measurements may also be made relative to the presence or absence of antibodies. Such methods of measuring growth factor levels, release, inhibition or removal include standard measurement in tissue and/or fluids (e.g. serum or blood) such as Western blot, enzyme-linked immunosorbent assay (ELISA), activity assays, reporter assays, luciferase assays, polymerase chain reaction (PCR) arrays, gene arrays, Real Time reverse transcriptase (RT) PCR and the like.

Antibodies of the present invention may bind or interact with any number of epitopes on or along GPCs or their associated structures to either enhance or inhibit growth factor signaling. Such epitopes may include any and all possible sites for altering, enhancing or inhibiting GPC function. In some embodiments, such epitopes include, but are not limited to epitopes on or within growth factors, regulatory elements, GPCs, GPC modulatory factors, growth factor receiving cells or receptors, LAPs or LAP-like domains, fastener regions, furin cleavage sites, arm regions, fingers regions, LTBP binding domains, fibrillin binding domains, glycoprotein A repetitions predominant (GARP) binding domains, latency lassos, alpha 1 regions, RGD sequences, bowtie regions, extracellular matrix and/or cellular matrix components and/or epitopes formed by combining regions or portions of any of the foregoing.

Compounds and/or compositions of the present invention exert their effects via binding (reversibly or irreversibly) to one or more epitopes and/or regions of antibody recognition. While not wishing to be bound by theory, such binding sites for antibodies, are most often formed by proteins, protein domains or regions. Binding sites may; however, include biomolecules such as sugars, lipids, nucleic acid molecules or any other form of binding epitope.

In some embodiments, antagonist antibodies of the present invention may bind to TGF-β prodomains, stabilizing and preventing integrin-mediated release, for example, by blocking the RGD site or by stabilizing the structure. Such antibodies would be useful in the treatment of Camurati-Engelmann disease, in which mutations in the prodomain cause excessive TGF-β activation. Such antibodies would also be useful in Marfan's syndrome, in which mutations in fibrillins or LTBPs alter TGF-β and BMP activation.

In some embodiments, antibodies of the present invention selectively inhibit the release of TGF-β from GPCs associated with LTBPs but not those associated with GARP. Such antibodies function as anti-fibrotic therapeutics but exhibit minimal inflammatory effects. In some embodiments, GPC-LTBP complex-binding antibodies do not bind GPC-GARP complexes. In some embodiments, such antibodies, may not be specific to a particular LTBP or GPC, but may bind to GPCs close to or overlapping with GARP binding sites, such that binding is impeded by GARP, but not by LTBPs. In some embodiments, antibodies are provided that selectively bind one or more combinatorial epitopes between GARP and pro-TGF-β. In some embodiments of the present invention, compounds and/or compositions are provided which induce release of TGF-β from GARP-proTGF-β complexes. Such antibodies may be selected for their ability to bind to GARP prodomain binary complexes but not GARP-proTGF-β ternary complexes, GARPs alone, or prodomains alone.

Alternatively or additionally, antibodies of the present invention may function as ligand mimetics which would induce internalization of GPCs. Such antibodies may act as nontraditional payload carriers, acting to deliver and/or ferry bound or conjugated drug payloads to specific GPC and/or GPC-related sites.

Changes elicited by antibodies of the present invention may result in neomorphic changes in the cell. As used herein, the term "neomorphic change" refers to a change or alteration that is new or different. For example, an antibody that elicits the release or stabilization of one or more growth factor not typically associated with a particular GPC targeted by the antibody, would be a neomorphic antibody and the release would be a neomorphic change.

In some embodiments, compounds and/or compositions of the present invention may act to alter and/or control proteolytic events. In some embodiments, such proteolytic events may be intracellular or extracellular. In some embodiments, such proteolytic events may include the alteration of furin cleavage and/or other proteolytic processing events. In some embodiments, such proteolytic events may comprise proteolytic processing of growth factor signaling molecules or downstream cascades initiated by growth factor signaling molecules.

In some embodiments, compounds and/or compositions of the present invention may induce or inhibit dimerization or multimerization of growth factors (ligands) or their receptors. In some embodiments, such actions may be through stabilization of monomeric, dimeric or multimeric forms or through the disruption of dimeric or multimeric complexes.

In some embodiments, compounds and/or compositions of the present invention may act on homo and/or heterodimers of the monomeric units comprising either receptor groups or GPCs or other signaling molecule pairs.

Antibodies of the present invention may be internalized into cells prior to binding target antigens. Upon internalization, such antibodies may act to increase or decrease one or more signaling events, release or stabilize one or more GPCs, block or facilitate growth factor release and/or alter one or more cell niche.

In some embodiments, compounds and/or compositions of the present invention may also alter the residence time of one or more growth factor in one or more GPC and/or alter the residence time of one or more GPC in the extracellular matrix and/or cellular matrix. Such alterations may result in irreversible localization and/or transient localization.

Antibodies of the present invention may be designed, manufactured and/or selected using any methods known to one of skill in the art. In some embodiments, antibodies and/or antibody producing cells of the present invention are produced according to any of the methods listed in U.S. Provisional Patent Applications 61/722,919, filed Nov. 6, 2012 and 61/722,969, filed Nov. 6, 2012, the contents of each of which are herein incorporated by reference in their entireties.

Antibody Generation in Knockout Mice

In some embodiments, antibodies of the current invention may be generated in knockout mice that lack a gene encoding one or more desired antigens. Such mice would not be tolerized to such antigens and therefore may be able to generate antibodies against them that could cross react with human and mouse forms of the antigen. For the production of monoclonal antibodies, host mice are immunized with the target peptide to elicit lymphocytes that specifically bind that peptide. Lymphocytes are collected and fused with an immortalized cell line. The resulting hybridoma cells are cultured in a suitable culture medium with a selection agent to support the growth of only the fused cells.

In some embodiments, knocking out one or more growth factor gene may be lethal and/or produce a fetus or neonate that is non-viable. In some embodiments, neonatal animals may only survive for a matter of weeks (e.g. 1, 2, 3, 4 or 5 weeks). In such embodiments, immunizations may be carried out in neonatal animals shortly after birth. Oida et al (Oida, T. et al., TGF-β induces surface LAP expression on Murine CD4 T cells independent of FoxP3 induction. PLOS One. 2010. 5(11):e15523) demonstrate immunization of neonatal TGF-β knockout mice through the use of galectin-1 injections to prolong survival (typically 3-4 weeks after birth in these mice). Mice were immunized with cells expressing murine TGF-β every other day for 10 days beginning on the $8^{th}$ day after birth and spleen cells were harvested on day 22 after birth. Harvested spleen cells were fused with myeloma cells and of the resulting hybridoma cells, many were found to successfully produce anti-LAP antibodies. In some embodiments of the present invention, these methods may be used to generate antibodies. In some embodiments, such methods may comprise the use of human antigens. In some embodiments, cells used for immunization may express TGF-β and GARP. In such embodiments, GARPs may be expressed with native transmembrane domains to allow for GARP-TGF-β complexes to remain tethered to the cell surface of the transfected cells used from immunization. Some antigens may comprise proTGF-β1 tethered to LTBP (e.g. LTBP1S.) In some cases, recombinant proteins related to other TGF-β family members may be used as antigens.

Methods of the present invention may also comprise one or more steps of the immunization methods described by Oida et al combined with one or more additional and/or modified steps. Modified steps may include, but are not limited to the use of alternate cell types for fusions, the pooling of varying number of spleen cells when performing fusions, altering the injection regimen, altering the date of spleen cell harvest, altering immunogen and/or altering immunogen dose. Additional steps may include the harvesting of other tissues (e.g. lymph nodes) from immunized mice.

Activating and Inhibiting Antibodies

Antibodies of the present invention may comprise activating or inhibiting antibodies. As used herein, the term "activating antibody" refers to an antibody that promotes growth factor activity. Activating antibodies include antibodies targeting any epitope that promotes growth factor activity. Such epitopes may lie on prodomains (e.g. LAPs and LAP-like domains,) growth factors or other epitopes that when bound by antibody, lead to growth factor activity. Activating antibodies of the present invention may include, but are not limited to TGF-β-activating antibodies, GDF-8-activating antibodies, GDF-11-activating antibodies and BMP-activating antibodies.

As used herein, the term "inhibiting antibody" refers to an antibody that reduces growth factor activity. Inhibiting antibodies include antibodies targeting any epitope that reduces growth factor activity when associated with such antibodies. Such epitopes may lie on prodomains (e.g. LAPs and LAP-like domains,) growth factors or other epitopes that lead to reduced growth factor activity when bound by antibody. Inhibiting antibodies of the present invention may include, but are not limited to TGF-β-inhibiting antibodies, GDF-8-inhibiting antibodies, GDF-11-inhibiting antibodies and BMP-inhibiting antibodies.

Embodiments of the present invention include methods of using activating and/or inhibiting antibodies in solution, in cell culture and/or in subjects to modify growth factor signaling.

Anti-LAP and Anti-LAP-Like Domain Antibodies

In some embodiments, compounds and/or compositions of the present invention may comprise one or more antibody targeting a prodomain, including LAP and/or LAP-like domains. Such antibodies may reduce or elevate growth factor signaling depending on the specific LAP or LAP-like domain that is bound and/or depending on the specific epitope targeted by such antibodies. Anti-LAP and/or anti-LAP-like protein antibodies of the invention may promote dissociation of free growth factors from GPCs. Such dissociation may be induced upon antibody binding to a GPC or dissociation may be promoted by preventing the reassociation of free growth factor with LAP or LAP-like protein. In some cases, anti-TGF-β LAP antibodies are provided. Anti-TGF-β LAP antibodies may comprise TGF-β-activating antibodies. Such antibodies may increase TGF-β activity, in some cases through by releasing TGF-β free growth factor from latent GPCs and/or preventing the reassociation of free TGF-β growth factor with LAP. In some cases, anti-TGF-β LAP antibodies may increase TGF-β activity more favorably when proTGF-β is associated with LTBP. In some cases, anti-TGF-β LAP antibodies may increase TGF-β activity more favorably when proTGF-β is associated with GARP. In some cases, anti-TGF-β LAP antibodies may function synergistically with other TGF-β activators (e.g. $\alpha v \beta_6$ and/or $\alpha v \beta_8$) to increase TGF-β activity.

Variations

Compounds and/or compositions of the present invention may exist as a whole polypeptide, a plurality of polypeptides or fragments of polypeptides, which independently may be encoded by one or more nucleic acids, a plurality of nucleic acids, fragments of nucleic acids or variants of any of the aforementioned. As used herein, the term "polypeptide" refers to a polymer of amino acid residues (natural or unnatural) linked together most often by peptide bonds. The term, as used herein, refers to proteins, polypeptides, and peptides of any size, structure, or function. In some instances the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides and may be associated or linked. The term polypeptide may also apply to amino acid polymers in which one or more amino acid residues are an artificial chemical analogue of a corresponding naturally occurring amino acid.

As used herein, the term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" refers to a variant which contains one or more amino acids which would mimic an activated sequence. For example, glutamate may serve as a mimic for phospho-threonine and/or phospho-serine. Alternatively, variant mimics may result in deactivation or in an inactivated product containing the mimic, e.g., phenylalanine may act as an inactivating substitution for tyrosine; or alanine may act as an inactivating substitution for serine. The amino acid sequences of the compounds and/or compositions of the invention may comprise naturally occurring amino acids and as such may be considered to be proteins, peptides, polypeptides, or fragments thereof. Alternatively, the compounds and/or compositions may comprise both naturally and non-naturally occurring amino acids.

As used herein, the term "amino acid sequence variant" refers to molecules with some differences in their amino acid sequences as compared to a native or starting sequence. The amino acid sequence variants may possess substitutions, deletions, and/or insertions at certain positions within the amino acid sequence. As used herein, the terms "native" or "starting" when referring to sequences are relative terms referring to an original molecule against which a comparison may be made. Native or starting sequences should not be confused with wild type sequences. Native sequences or molecules may represent the wild-type (that sequence found in nature) but do not have to be identical to the wild-type sequence.

Ordinarily, variants will possess at least about 70% homology to a native sequence, and preferably, they will be at least about 80%, more preferably at least about 90% homologous to a native sequence.

As used herein, the term "homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

As used herein, the term "homolog" as it applies to amino acid sequences is meant the corresponding sequence of other species having substantial identity to a second sequence of a second species.

As used herein, the term "analog" is meant to include polypeptide variants which differ by one or more amino acid alterations, e.g., substitutions, additions or deletions of amino acid residues that still maintain the properties of the parent polypeptide.

As used herein, the term "derivative" is used synonymously with the term "variant" and refers to a molecule that has been modified or changed in any way relative to a reference molecule or starting molecule.

The present invention contemplates several types of compounds and/or compositions which are amino acid based including variants and derivatives. These include substitutional, insertional, deletional and covalent variants and derivatives. As such, included within the scope of this invention are compounds and/or compositions comprising substitutions, insertions, additions, deletions and/or covalent modifications. For example, sequence tags or amino acids, such as one or more lysines, can be added to peptide sequences of the invention (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to proteins are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein, the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

As used herein, the term "insertional variants" when referring to proteins are those with one or more amino acids inserted immediately adjacent to an amino acid at a particular position in a native or starting sequence. As used herein, the term "immediately adjacent" refers to an adjacent amino acid that is connected to either the alpha-carboxy or alpha-amino functional group of a starting or reference amino acid.

As used herein, the term "deletional variants" when referring to proteins, are those with one or more amino acids in the native or starting amino acid sequence removed. Ordinarily, deletional variants will have one or more amino acids deleted in a particular region of the molecule.

As used herein, the term "derivatives," as referred to herein includes variants of a native or starting protein comprising one or more modifications with organic proteinaceous or non-proteinaceous derivatizing agents, and post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Certain post-translational modifications are the result of the action of recombinant host cells on the expressed polypeptide. Glutaminyl and asparaginyl residues are frequently post-translationally deamidated to the corresponding glutamyl and aspartyl residues. Alternatively, these residues are deamidated under mildly acidic conditions. Either form of these residues may be present in the proteins used in accordance with the present invention.

Other post-translational modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)).

Covalent derivatives specifically include fusion molecules in which proteins of the invention are covalently bonded to a non-proteinaceous polymer. The non-proteinaceous polymer ordinarily is a hydrophilic synthetic polymer, i.e. a polymer not otherwise found in nature. However, polymers which exist in nature and are produced by recombinant or in vitro methods are useful, as are polymers which are isolated from nature. Hydrophilic polyvinyl polymers fall within the scope of this invention, e.g. polyvinylalcohol and polyvinylpyrrolidone. Particularly useful are polyvinylalkylene ethers such a polyethylene glycol, polypropylene glycol. The proteins may be linked to various non-proteinaceous polymers, such as polyethylene glycol, polypropylene glycol or polyoxyalkylenes, in the manner set forth in U.S. Pat. Nos. 4,640,835; 4,496,689; 4,301,144; 4,670,417; 4,791,192 or 4,179,337.

As used herein, the term "features" when referring to proteins are defined as distinct amino acid sequence-based components of a molecule. Features of the proteins of the present invention include surface manifestations, local conformational shape, folds, loops, half-loops, domains, half-domains, sites, termini or any combination thereof.

As used herein, the term "surface manifestation" when referring to proteins refers to a polypeptide based component of a protein appearing on an outermost surface.

As used herein, the term "local conformational shape" when referring to proteins refers to a polypeptide based structural manifestation of a protein which is located within a definable space of the protein.

As used herein, the term "fold", when referring to proteins, refers to the resultant conformation of an amino acid sequence upon energy minimization. A fold may occur at the secondary or tertiary level of the folding process. Examples of secondary level folds include beta sheets and alpha helices. Examples of tertiary folds include domains and regions formed due to aggregation or separation of energetic forces. Regions formed in this way include hydrophobic and hydrophilic pockets, and the like.

As used herein, the term "turn" as it relates to protein conformation, refers to a bend which alters the direction of the backbone of a peptide or polypeptide and may involve one, two, three or more amino acid residues.

As used herein, the term "loop," when referring to proteins, refers to a structural feature of a peptide or polypeptide which reverses the direction of the backbone of a peptide or polypeptide and comprises four or more amino acid residues. Oliva et al. have identified at least 5 classes of protein loops (Oliva, B. et al., An automated classification of the structure of protein loops. J Mol Biol. 1997. 266(4):814-30.)

As used herein, the term "half-loop," when referring to proteins, refers to a portion of an identified loop having at least half the number of amino acid resides as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2=3.5+/−0.5 being 3 or 4).

As used herein, the term "domain," when referring to proteins, refers to a motif of a polypeptide having one or more identifiable structural or functional characteristics or properties (e.g., binding capacity, serving as a site for protein-protein interactions.)

As used herein, the term "half-domain," when referring to proteins, refers to a portion of an identified domain having at least half the number of amino acid resides as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that sub-domains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein, the terms "site," as it pertains to amino acid based embodiments is used synonymously with "amino acid residue" and "amino acid side chain". A site represents a position within a peptide or polypeptide that may be modified, manipulated, altered, derivatized or varied within the polypeptide based molecules of the present invention.

As used herein, the terms "termini" or "terminus," when referring to proteins refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)). Proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a component of a molecule of the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involved deleting a domain would result in the alteration of the length of a molecule just as modification of a nucleic acid to encode less than a full length molecule would.

Modifications and manipulations can be accomplished by methods known in the art such as site directed mutagenesis. The resulting modified molecules may then be tested for activity using in vitro or in vivo assays such as those described herein or any other suitable screening assay known in the art.

In some embodiments, compounds and/or compositions of the present invention may comprise one or more atoms that are isotopes. As used herein, the term "isotope" refers to a chemical element that has one or more additional neutrons. In some embodiments, compounds of the present invention may be deuterated. As used herein, the term "deuterate" refers to the process of replacing one or more hydrogen atoms in a substance with deuterium isotopes. Deuterium isotopes are isotopes of hydrogen. The nucleus of hydrogen contains one proton while deuterium nuclei contain both a proton and a neutron. The compounds and/or compositions of the present invention may be deuterated in order to change one or more physical property, such as stability, or to allow compounds and/or compositions to be used in diagnostic and/or experimental applications.

Conjugates and Combinations

It is contemplated by the present invention that the compounds and/or compositions of the present invention may be complexed, conjugated or combined with one or more homologous or heterologous molecules. As used herein, the term "homologous molecule" refers to a molecule which is similar in at least one of structure or function relative to a starting molecule while a "heterologous molecule" is one that differs in at least one of structure or function relative to a starting molecule. Structural homologs are therefore molecules which may be substantially structurally similar. In some embodiments, such homologs may be identical. Functional homologs are molecules which may be substantially functionally similar. In some embodiments, such homologs may be identical.

Compounds and/or compositions of the present invention may comprise conjugates. Such conjugates of the invention may include naturally occurring substances or ligands, such as proteins (e.g., human serum albumin (HSA), low-density lipoprotein (LDL), high-density lipoprotein (HDL), or globulin); carbohydrates (e.g., a dextran, pullulan, chitin, chitosan, inulin, cyclodextrin or hyaluronic acid); or lipids. Conjugates may also be recombinant or synthetic molecules, such as synthetic polymers, e.g., synthetic polyamino acids, an oligonucleotide (e.g. an aptamer). Examples of polyamino acids may include polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

In some embodiments, conjugates may also include targeting groups. As used herein, the term "targeting group" refers to a functional group or moiety attached to an agent that facilitates localization of the agent to a desired region, tissue, cell and/or protein. Such targeting groups may include, but are not limited to cell or tissue targeting agents or groups (e.g. lectins, glycoproteins, lipids, proteins, an antibody that binds to a specified cell type such as a kidney cell or other cell type). In some embodiments, targeting groups may comprise thyrotropins, melanotropins, lectins, glycoproteins, surfactant protein A, mucin carbohydrates, multivalent lactose, multivalent galactose, N-acetyl-galactosamine, N-acetyl-gulucosamine, multivalent mannose, multivalent fucose, glycosylated polyaminoacids, multivalent galactose, transferrin, bisphosphonate, polyglutamate, polyaspartate, lipids, cholesterol, steroids, bile acids, folates, vitamin B12, biotin, an RGD peptide, an RGD peptide mimetic or an aptamer.

In some embodiments, targeting groups may be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also comprise hormones and/or hormone receptors.

In some embodiments, targeting groups may be any ligand capable of targeting specific receptors. Examples include, without limitation, folate, GalNAc, galactose, mannose, mannose-6-phosphate, apatamers, integrin receptor ligands, chemokine receptor ligands, transferrin, biotin, serotonin receptor ligands, PSMA, endothelin, GCPII, somatostatin, LDL, and HDL ligands. In some embodiments, targeting groups are aptamers. Such aptamers may be unmodified or comprise any combination of modifications disclosed herein.

In still other embodiments, compounds and/or compositions of the present invention may be covalently conjugated to cell penetrating polypeptides. In some embodiments, cell-penetrating peptides may also include signal sequences. In some embodiments, conjugates of the invention may be designed to have increased stability, increased cell transfection and/or altered biodistribution (e.g., targeted to specific tissues or cell types.)

In some embodiments, conjugating moieties may be added to compounds and/or compositions of the present invention such that they allow the attachment of detectable labels to targets for clearance. Such detectable labels include, but are not limited to biotin labels, ubiquitins, fluorescent molecules, human influenza hemaglutinin (HA), c-myc, histidine (His), flag, glutathione S-transferase (GST), V5 (a paramyxovirus of simian virus 5 epitope), biotin, avidin, streptavidin, horse radish peroxidase (HRP) and digoxigenin.

In some embodiments, compounds of the invention may be conjugated with an antibody Fc domain to create an Fc fusion protein. The formation of an Fc fusion protein with any of the compounds described herein may be carried out according to any method known in the art, including as described in U.S. Pat. Nos. 5,116,964, 5,541,087 and 8,637,637, the contents of each of which are herein incorporated by reference in their entirety. Fc fusion proteins of the invention may comprise a compound of the invention linked to the hinge region of an IgG Fc via cysteine residues in the Fc hinge region. Resulting Fc fusion proteins may comprise an antibody-like structure, but without Cm domains or light chains. In some cases, Fc fusion proteins may comprise pharmacokinetic profiles comparable to native antibodies. In some cases, Fc fusion proteins of the invention may comprise extended half-life in circulation and/or altered biological activity.

In some embodiments, compounds and/or compositions of the present invention may be combined with one another or other molecules in the treatment of diseases and/or conditions.

Nucleic Acids

In some embodiments, compounds and/or compositions of the present invention may be encoded by nucleic acid molecules. Such nucleic acid molecules include, without limitation, DNA molecules, RNA molecules, polynucleotides, oligonucleotides, mRNA molecules, vectors, plasmids and the like. In some embodiments, the present invention may comprise cells programmed or generated to express nucleic acid molecules encoding compounds and/or compositions of the present invention.

Methods of Use

Methods of the present invention include methods of modifying growth factor activity in one or more biological system. Such methods may include contacting one or more biological system with a compound and/or composition of the invention. In some cases, these methods include modifying the level of free growth factor in a biological system (e.g. in a cell niche or subject.) Compounds and/or compostions according to such methods may include, but are not limited to biomolecules, including, but not limited to recombinant proteins, protein complexes and/or antibodies described herein.

In some embodiments, methods of the present invention may be used to initiate or increase growth factor activity, termed "activating methods" herein. Some such methods may comprise growth factor release from a GPC and/or inhibition of growth factor reassociation into a latent GPC. In some cases, activating methods may comprise the use of an antibody, a recombinant protein and/or a protein complex. According to some activating methods, one or more activating antibody is provided. In such methods, one or more growth factor may be released or prevented from being drawn back into a GPC. In one, non-limiting example, an anti-LAP antibody may be provided that enhances dissociation between a growth factor and a GPC and/or prevents reformation of a GPC.

Embodiments of the present invention include methods of using anti-LAP and/or anti-LAP-like domain antibodies to modify growth factor activity. In some cases, such methods may include the use of anti-TGF-β-LAP antibodies as TGF-β-activating antibodies. In some cases, methods of using and/or testing such antibodies may include any of the methods taught in Tsang, M. et al. 1995. Cytokine 7(5):389-97, the contents of which are herein incorporated by reference in their entirety.

In some embodiments, methods of the present invention may be used to reduce or eliminate growth factor activity, termed "inhibiting methods" herein. Some such methods may comprise growth factor retention in a GPC and/or promotion of reassociation of growth factor into a latent GPC. In some cases, inhibiting methods may comprise the use of an antibody Therapeutics In some embodiments, compositions and methods of the invention may be used to treat a wide variety of diseases, disorders and/or conditions. In some cases, such diseases, disorders and/or conditions may be TGF-β-related indications. As used herein, the term "TGF-β-related indication" refers to any disease, disorder and/or condition related to expression, activity and/or metabolism of a TGF-β family member protein or any disease, disorder and/or condition that may benefit from modulation of the activity and/or levels of one or more TGF-β family member protein. TGF-β-related indications may include, but are not limited to, fibrosis, anemia of the aging, cancer (including, but not limited to colon, renal, breast, malignant melanoma and glioblastoma,) facilitation of rapid hematopoiesis following chemotherapy, bone healing, endothelial proliferation syndromes, asthma and allergy, gastrointestinal disorders, aortic aneurysm, orphan indications (such as Marfan's syndrome and Camurati-Engelmann disease,) obesity, diabetes, arthritis, multiple sclerosis, muscular dystrophy, amyotrophic lateral sclerosis (ALS,) Parkinson's disease, osteoporosis, osteoarthritis, osteopenia, metabolic syndromes, nutritional disorders, organ atrophy, chronic obstructive pulmonary disease (COPD,) and anorexia. Additional indications may include any of those disclosed in US Pub. No. 2013/0122007, U.S. Pat. No. 8,415,459 or International Pub. No. WO 2011/151432, the contents of each of which are herein incorporated by reference in their entirety.

Efficacy of treatment or amelioration of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. In connection with the administration of compositions of the present invention, "effective against" for example a cancer, indicates that administration in a clinically appropriate manner results in a beneficial effect for at least a statistically significant fraction of patients, such as an improvement of symptoms, a cure, a reduction in disease load, reduction in tumor mass or cell numbers, extension of life, improvement in quality of life, or other effect generally recognized as positive by medical doctors familiar with treating the particular type of cancer.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given composition or formulation of the present invention can also be judged using an experimental animal model for the given disease as known in the art. When using an experimental animal model, efficacy of treatment is evidenced when a statistically significant change is observed.

Therapeutics for Fibrosis

In some embodiments, compounds and/or compositions of the present invention may be useful for altering fibrosis. In some embodiments, such compounds and/or compositions are antagonists of TGF-β. TGF-β is recognized as the central orchestrator of the fibrotic response. Antibodies targeting TGF-β decrease fibrosis in numerous preclinical models. Such antibodies and/or antibody-based compounds include LY2382770 (Eli Lilly, Indianapolis, Ind.). Also included are those described in U.S. Pat. No. 6,492,497, U.S. Pat. No. 7,151,169 and U.S. Pat. No. 7,723,486 and U.S. publication US2011/0008364, the contents of each of which are herein incorporated by reference in their entirety.

Fibrosis is a common sequela of many types of tissue destructive diseases. When new space is created by the disruption of differentiated cells, progenitors or stem cells that normally occupy a niche in the tissue, the default pathway appears to be the proliferation of connective tissue cells, e.g. fibroblasts, to fill in the empty space. This is accompanied by the production of extracellular matrix constituents including collagens that result in scarring and permanent effacement of the tissue.

A difficult aspect of fibrosis is its chronicity, which may require continued therapy until the underlying destruction of parenchymal cells is terminated or the cells are replaced by stem cell pools, or by transplantation. Fibrosis is thought to be much easier to arrest than to reverse. The TGF-beta family is of central importance in regulating the growth of fibroblastic cells and the production of extracellular matrix constituents including collagen. Integrins $\alpha v \beta_6$ and $\alpha v \beta_8$ (and possibly $\alpha v \beta_1$) may participate in activation of TGF-beta1 and 3. The integrin VLA-1 is a receptor for collagen and is expressed on lymphocytes only late after their activation and is strongly implicated in the development of fibrotic disease.

In some embodiments, compounds and/or compositions of the present invention are designed to block integrin $\alpha v \beta_6$, $\alpha v \beta_8$ and $\alpha v \beta_1$ activation of TGF-beta for inhibiting fibrosis. In some embodiments, compounds and/or compositions of the present invention are designed to target interaction sites between GPCs and LTBPs while leaving interaction sites between GPCs and GARP unaffected. Such compounds and/or compositions of the present invention may act as inhibitory antibodies, preventing growth factor signaling and inhibiting fibrosis. In some embodiments, compounds and/or compositions of the present invention are designed to target one or more of TGF-β1, 2 and 3 or chimeric antigens thereof.

Fibrotic indications for which compounds and/or compositions of the present invention may be used therapeutically include, but are not limited to lung indications [e.g. Idiopathic Pulmonary Fibrosis (IPF), Chronic Obstructive Pulmonary Disorder (COPD), Allergic Asthma, Acute Lung injury, Eosinophilic esophagitis, Pulmonary arterial hypertension and Chemical gas-injury,] kidney indications [e.g. Diabetic glomerulosclerosis, Focal segmental glomeruloclerosis (FSGS), Chronic kidney disease, Fibrosis associated with kidney transplantation and chronic rejection, IgA nephropathy and Hemolytic uremic syndrome,] liver fibrosis [e.g. Non-alcoholic steatohepatitis (NASH), Chronic viral hepatitis, Parasitemia, Inborn errors of metabolism, Toxin-mediated fibrosis, such as alcohol fibrosis, Non-alcoholic steatohepatitis-hepatocellular carcinoma (NASH-HCC), Primary biliary cirrhosis and Sclerosing cholangitis,] cardiovascular fibrosis (e.g. cardiomyopathy, hypertrophic cardiomyopathy, atherosclerosis and restenosis,) systemic sclerosis, skin fibrosis (e g Skin fibrosis in systemic sclerosis, Diffuse cutaneous systemic sclerosis, Scleroderma, Pathological skin scarring, Keloid, Post surgical scarring, Scar revision surgery, Radiation-induced scarring and Chronic wounds) and cancers or secondary fibrosis (e.g. Myelofibrosis, Head and Neck Cancer, M7 acute Megakaryoblastic Leukemia and Mucositis.) Other diseases, disorders or conditions related to fibrosis that may be treated using compounds and/or compositions of the present invention, include, but are not limited to Marfan's Syndrome, Stiff Skin Syndrome, Scleroderma, Rheumatoid arthritis, bone marrow fibrosis, Crohn's disease, Ulcerative colitis, Systemic lupus erythematosus, Muscular Dystrophy, Dupuytren's contracture, Camurati-Engelmann Disease, Neural scarring, Proliferative vitreoretinopathy, corneal injury, complications after glaucoma drainage surgery and Multiple Sclerosis.

Assays useful in determining the efficacy of the compounds and/or compositions of the present invention for the alteration of fibrosis include, but are not limited to, histological assays for counting fibroblasts and basic immunohistochemical analyses known in the art.

Animal models are also available for analysis of the efficacy of compounds and/or compositions of the present invention in altering fibrosis. Examples of animal fibrosis models useful for such analysis may include, for example, any of those taught by Schaefer, D. W. et al., 2011. Eur Respir Rev. 20: 120, 85-97, the contents of which are herein incorporated by reference in their entirety. Such models may include, but are not limited to those described in Table 1 of that publication, including lung models, renal models, liver models, cardiovascular models and/or collagen-induced models. Schaefer et al also teach the use of pirfenidone in the treatment of fibrosis. In some cases, compounds and/or compositions of the present invention may be used in combination with pirfenidone.

In some cases, compounds and/or composition of the invention may be used in the treatment of lung fibrosis. Lung fibrosis models may be used in the development and/or testing of compounds and/or compositions of the invention. Lung fibrosis models may include the bleomycin induced lung injury models and/or chronic bleomycin induced lung injury models. Bleomycin induced lung injury models may be carried out as described by Schaefer et al, and also by Horan et al. (Horan G. S. et al., 2008. *Am J Respir Crit Care Med,* 177(1): 56-65. Epub 2007 Oct. 4, the contents of each of which are herein incorporated by reference in their entirety.) According to the Horan study, SV129 mice are tracheally exposed to bleomycin which results in the development of lung fibrosis. With this model, potential therapeutics are administered through intraperitoneal injections while postmortem lung tissue or bronchoalveolar lavage collections can be assayed for levels of hydroxyproline as an indicator of fibrotic activity. Using the same technique, mice carrying a luciferase reporter gene, driven by the collagen Iα2 gene promoter may be used in the model so that fibrotic activity may be determined by luciferase activity assay as a function of collagen gene induction. Additional bleomycin induced lung models may be carried out according to those described by Thrall et al (Thrall, R. S. et al., 1979. Am J Pathol. 95:117-30, the contents of which are herein incorporated by reference in their entirety.) Additional lung models may include the mouse asthma models. Airway remodeling (lung fibrosis) may be a serious problem in subjects with chronic asthma. Asthma models may include any of those described by Nials et al (Nials, A. T. et al., 2008. Disease Models and Mechanisms. 1:213-20, the contents of wich are herein incorporated by reference in their entirety.) Models of chronic obstructive pulmonary disease (COPD) may be used. Such models may include any of those described by Vlahos et al (Vlahos, R. et al., 2014. Clin Sci. 126:253-65, the contents of which are herein incorporated by reference in their entirety.) Models of cigarette smoking emphysema may be used. Such models may be carried out as described in Ma et al. 2005. J Clin Invest. 115:3460-72, the contents of which are herein incorporated by reference in their entirety. Models of chronic pulmonary fibrosis may be used. Such models in rodents may be carried out according to the intratracheal fluorescein isothiocyanate (FITC) instillation model described in Roberts, S. N. et al. 1995. J Pathol. 176(3):309-18, the contents of which are herein incorporated by reference in their entirety. Models of asbestos and silica induced lung injury may also be used. Such models may be carried out as described in Coin, P. G. et al., 1996. Am J Respir Crit Care Med. 154(5):1511-9, the contents of which are herein incorporated by reference in their entirety. In some cases, models of lung irradiation may be used. Such models may be carried out as described in Pauluhn, J. et al. 2001. Toxicology. 161:153-63, the contents of which are herein incorporated by reference in their entirety. In some cases, phorbol myristate acetate (PMA)-induced lung injury models may be used. Such models may be carried out as described in Taylor, R. G. et al., 1985. Lab Invest. 52(1):61-70, the contents of which are herein incorporated by reference in their entirety.

Renal fibrosis models may be utilized to develop and/or test compounds and/or compositions of the present invention. In some embodiments, a well established model of renal fibrosis, unilateral ureteral obstruction (UUO) model, may be used. In this model, mice are subjected to proximal ureteral ligation. After a period of hours to days, fibrosis is examined in the regions blocked by ligation (Ma, L. J. et al., 2003. American Journal of Pathology. 163(4):1261-73, the contents of which are herein incorporated by reference in their entirety.) In one example, this method was utilized by Meng, X. M. et al. (Meng, X. M. et al., Smad2 Protects against TGF-beta/Smad3-Mediated Renal Fibrosis. J Am Soc Nephrol. 2010 September; 21(9):1477-87. Epub 2010 Jul. 1) to examine the role of SMAD-2 in renal fibrosis. SMAD-2 is an intracellular member of the TGF-beta cell signaling pathway. In some cases, cyclosporine A-induced nephropathy models may be used. Such models may be carried out as described in Ling, H. et al., 2003. J Am Soc Nephrol. 14:377-88, the contents of which are herein incorporated by reference in their entirety. In some cases, renal models of Alport Syndrome may be used. Transgenic mice with collagen III knockout may be used in Alport syndrome studies. These mice develop progressive fibrosis in their kidneys. Alport syndrome models may be carried out as described in Koepke, M. L. et al., 2007. Nephrol Dial Transplant. 22(4):1062-9 and/or Hahm, K. et al., 2007. Am J Pathol. 170(1):110-5, the contents of each of which are herein incorporated by reference in their entirety.

In some cases, models of cardiovascular fibrosis may be used to develop and/or test compounds and/or compositions of the invention for treatment of cardiovascular fibrotic indications. In some cases, vascular injury models may be used. Such models may include balloon injury models. In some cases, these may be carried out as described in Smith et al., 1999. Circ Res. 84(10):1212-22, the contents of which are herein incorporated by reference in their entirety. Blocking TGF-β in this model was shown to block neointima formation. Accordingly, TGF-β inhibiting antibodies of the present invention may be used to reduce and/or block neointima formation.

In some embodiments, models of liver fibrosis may be used to develop and/or test compounds and/or compositions of the invention for treatment of liver fibrotic indications. Liver models may include any of those described in Iredale, J. P. 2007. J Clin Invest. 117(3):539-48, the contents of which are herein incorporated by reference in their entirety. These include, but are not limited to, any of the models listed in Tables 1 and/or 2. In some cases, liver models may include carbon tetrachloride induced liver fibrosis models. Such models may be carried out according to the methods described in Fujii, T. et al., 2010. BMC Gastroenterology. 10:79, the contents of which are herein incorporated by reference in their entirety.

In some embodiments, models of wound healing may be used to develop and/or test compounds and/or compositions of the invention for treatment of fibrotic wound indications. Wound models may include chronic wound models.

In some cases, models of GI injury-related fibrosis may be used to develop and/or test compounds and/or compositions of the invention for treatment of GI-related fibrosis. Such injury models may include, but are not limited to 2,4,6-trinitrobenzenesulfonic acid (TNBS) induced colitis models. Such models may be carried out as described in Scheiffele, F. et al., 2002. Curr Protoc Immunol. Chapter 15:Unit 15.19, the contents of which are herein incorporated by reference in their entirety.

In some embodiments, compounds and/or compositions of the invention may be used to treat diseases, disorders and/or conditions related to bone marrow fibrosis. In some cases, bone marrow fibrosis models may be used to develop and/or test such compounds and/or compositions. Models may include the marrow cell adoptive transfer model described in Lacout, C. et al., 2006. Blood. 108(5):1652-60 and transgenic mouse models, including, but not limited to the model described in Vannucchi, A. M. et al., 2002. Blood. 100(4):1123-32, the contents of each of which are herein incorporated by reference in their entirety. Further models may include models of thrombopoietin-induced myelofibrosis. Such models may be carried out as described in Chagraoui, H. et al., 2002. Blood. 100(10):3495-503, the contents of which are herein incorporated by reference in their entirety.

In some embodiments, compounds and/or compositions of the invention may be used to treat diseases, disorders and/or conditions related to muscular dystrophy (MD) including, but not limited to Duchenne MD and Becker MD. In some cases MD models may be used to develop and/or test such compounds and/or compositions. Such models may include those described in Ceco, E. et al., 2013. FEBS J. 280(17):4198-209, the contents of which are herein incorporated by reference in their entirety.

Compounds and/or compositions of the invention may, in some cases, be combined with one or more other therapeutics for the treatment of one or more fibrotic indication. Examples of such other therapeutics may include, but are not limited to LPA1 receptor antagonists, lysyl oxidase 2 inhibitors, hedgehog inhibitors, IL-3/IL-4 inhibitors, CTGF inhibitors, anti-$\alpha v \beta_6$ antibodies and anti-IL-13 antibodies.

In some cases, compounds and/or compositions of the present invention are designed to increase TGF-β growth factor activity to promote fibrosis to treat diseases, disorders and/or conditions where fibrosis may be advantageous. Such compounds may include activating antibodies.

Therapeutics for Myelofibrosis

Myelofibrosis is a chronic blood cancer caused by mutations in bone marrow stem cells. Disease is characterized by an impaired ability to make normal blood cells. Patients develop splenomegaly and hepatomegaly and excessive fibrosis occurs in the bone marrow. Myeloproliferative neoplasms (MPNs) are the collective name for three related types of myelofibrosis with different clinical features: primary myelofibrosis (PMF), essential thrombocythemia and polycythemia vera. All three have overactive signaling of the JAK-STAT cell signaling pathway (Klampfl, et al., 2013. NEJM 369:2379-90, the contents of which are herein incorporated by reference in their entirety.) Primary myelofibrosis (PMF) is characterized by increased angiogenesis, reticulin and collagen fibrosis. As the disease advances, the number of osteoclasts increase and bone marrow becomes unaspirable. Some fibrosis of PMF may be reversed by stem cell transplantation (SCT.) 98% of individuals with polycythemia vera have mutated JAK2 leading to overactive JAK-STAT signaling.

Current therapeutics for MPNs include allogeneic hematopoietic cell transplantation (HCT) and Janus kinase (JAK) inhibition. Allogeneic HCT is associated with up to 10% mortality as well as graft failure and significant side effects and toxicity. JAK inhibition therapy comprises the use of Ruxolitinib (Rux,) a small molecule inhibitor of JAK2 that was approved in 2011 to treat MPNs. Rux is marketed under the names JAKAFI® and JAKAVI® by Incyte pharmaceuticals (Wilmington, Del.) and Novartis (Basel, Switzerland). Although able to improve splenomegaly and hepatomegaly, Rux is not curative and some studies do not show much benefit (Odenike, O., 2013. Hematology. 2013(1):545-52, the contents of which are herein incorporated by reference in their entirety.)

In some cases, compounds and/or compositions of the invention may be used to treat myeloproliferative disorders, including, but not limited to primary myelofibrosis, secondary myelofibrosis, essential thrombocythemia, polycythemia vera, idiopathic myelofibrosis and chronic myeloid leukemia. In some cases, treatments may be carried out in combination with one or more known therapies for myelofibrosis, including, but not limited to allogeneic HCT, JAK inhibition, fresolimumab (GC1008; Genzyme, Cambridge, Mass.) treatment to block TGF-β1, 2 and 3 (Mascarenhas, J. et al., 2014. Leukemia and Lymphoma. 55:450-2, the contents of which are herein incorporated by reference in their entirety,) simtuzumab (Gilead Biosciences, Foster City, Calif.) treatment to block lysyl oxidase activity and collagen cross-linking and Pentraxin-2 (Promedior, Lexington, Mass.) treatment to stimulate regulatory macrophages and inhibit myelofibroblasts. In some cases, models of myeloproliferative disorders may be used to develop and/or test such compounds and/or compositions of the invention intended for the treatment of myelofibrosis. Models may include the marrow cell adoptive transfer model described in Lacout, C. et al., 2006. Blood. 108(5):1652-60 and transgenic mouse models, including, but not limited to the model described in Vannucchi, A. M. et al., 2002. Blood. 100(4):1123-32, the contents of each of which are herein incorporated by reference in their entirety. Myelofibrosis models may include thrombopoietin-induced myelofibrosis. Such models may be carried out as described in Chagraoui, H. et al., 2002. Blood. 100(10):3495-503, the contents of which are herein incorporated by reference in their entirety. TGF-β1 has been shown to be the primary agonist of fibrosis according to this model. Further myelofibrosis models may be carried out as described in Mullally, A. et al., 2010. Cancer Cell. 17:584-96, the contents of which are herein incorporated by reference in their entirety.

Therapeutics for Scarring and Wound Healing

In some embodiments, compounds and/or compositions of the present invention may be useful in altering wound healing and/or scar formation. In some cases, compounds and/or compositions of the invention may ensure proper wound healing (including, but not limited to chronic wounds.) In some cases, compounds and/or compositions of the invention may be used for reducing, treating and or preventing scar formation. Such compounds and/or compositions may comprise anti-TGF-β antibodies. In some cases, TGF-β-activating antibodies may be used to promote healing in wounds.

Therapeutics for Disorders of Iron Metabolism

In some embodiments, methods, compounds and/or compositions of the present invention may be used to treat disorders of iron metabolism. Such disorders may include disorders comprising reduced iron levels (e.g. anemias) or disorders comprising elevated iron levels (e.g. hemochromatosis.) BMP-6 and hemojuvelin interact to modulate hepcidin expression. Some methods, compounds and/or compositions of disclosed herein may be used to alter hepcidin levels, thereby regulating bodily iron levels.

Some embodiments of the present invention may comprise hepcidin agonists or hepcidin antagonists. Hepcidin agonists may activate or promote the expression and/or physiological action of hepcidin. Such agonists may be useful in the treatment or prevention of iron overload due to low hepcidin levels and/or activity. In some cases, agonists may not reverse established iron overload, but may diminish iron damage to tissues. Some hepcidin agonists of the present invention may elevate production of hepcidin through activating and/or enhancing BMP-6/hemojuvelin signaling.

Hepcidin antagonists may block or reduce the expression and/or physiological action of hepcidin. Such antagonists may be useful in the case of iron deficiency due to high hepcidin levels. In some embodiments, hepcidin antagonists of the present invention may comprise antibodies that disrupt BMP-6 signaling through hemojuvelin.

Anemias are conditions and/or diseases associated with decreased numbers of red blood cells and/or hemoglobin. Compounds and/or compositions of the present invention may be useful in treating anemias. Such anemias may include anemia of chronic disease (ACD), which is also referred to as anemia of inflammation (AI). Subjects with ACD, may suffer from chronic renal failure or acute inflammation due to rheumatoid arthritis, cancer, infection, etc. Subjects suffering from ACD typically comprise elevated levels of hepcidin and impaired erythropoiesis. In a study by Sasu et al (Sasu et al., 2010. Blood. 115(17):3616-24,) an antibody with high affinity for hepcidin was effective in treating murine anemia in a mouse model of inflammation. The studies found that the most effective treatments involved combining the antibody with an erythropoiesis-stimulating agent (ESA.) Accordingly, some compounds and/or compositions of the present invention may be used in combination with ESAs to increase efficacy. Current anti-hepcidin antibodies being tested for treatment of ACD include Ab12B9 (Amgen, Thousand Oaks, Calif.) and LY2787106 (Eli Lilly, Indianapolis, Ind.) FG4592 (FibroGen, San Francisco, Calif.) is a small molecule inhibitor of hypoxia-inducible factor (HIF) that is also currently used to treat anemia.

In some cases, compounds and/or compositions of the present invention may be used to treat subjects with iron deficiency anemia (IDA) associated with gastric bypass surgery and/or inflammatory bowel disease (IBD.) Gastric bypass surgery leaves subjects with a reduced ability to metabolize iron due to bypass of the proximal gastric pouch and duodenum (Warsh et al., 2013, the contents of which are herein incorporated by reference in their entirety.) IBD patients often suffer from iron deficiency due to intestinal blood loss and decreased absorption due to inflammation.

Some compounds and/or compositions of the present invention may be used to treat subjects suffering from iron-refractory iron deficiency anemia (IRIDA.) IRIDA is a genetic disease caused by a defect in the enzyme Matriptase-2 (De Falco, L. et al., 2013, the contents of which are herein incorporated by reference in their entirety.) Matriptase-2, a transmembrane serine protease, is an important hepcidin regulator. Matriptase-2 is capable of enzymatic cleavage of hemojuvelin. Subjects with defective Matriptase-2 activity have elevated levels of hemojuvelin, due to lack of degradation, and therefore hepcidin expression remains high and iron levels are reduced. Characteristics of the disease include, but are not limited to microcytic hypochromic anemia, low saturation of transferrin and normal to high levels of hepcidin. Some subjects with IRIDA are diagnosed soon after birth, but many are not diagnosed until adulthood. Treatments described herein may be used to modulate irregular hepcidin levels associated with IRIDA.

Iron overloading anemias can occur as a result of blood transfusion. Excess iron associated with transfused blood cannot be secreted naturally and requires additional treatments for removal, such as chelation therapy. Such therapy is generally not well tolerated and may comprise many side effects. Thus, there is a clinical need for new, better tolerated therapies. Additional therapies include EXJADE®, for the treatment of patients, age 10 and older, with non-transfusion-dependent thalassemia (NTDT) syndromes. Also included is ACE-536, a ligand trap that blocks TGF-β superfamily members. Both EXJADE and ACE-536 are known to elevate erythropoiesis. In some embodiments, compounds and/or compositions of the present invention may be used to control iron overloading. Some such embodiments may function to redistribute iron from parenchyma to macrophages where iron is better tolerated. In some cases this may be carried out through elevation of hepcidin levels. In studies by Gardenghi et al (Gardenghi et al., 2010, JCI. 120(12):4466-77,) overexpression of murine hepcidin was able to increase hemoglobin levels and decrease iron overload in mouse model of β-thalassemia and a mouse model of hemochromatosis (Viatte et al., 2006, Blood. 107:2952.)

GDF-15 levels in circulation have been found to negatively correlate with hepcidin levels, suggesting a role for GDF-15 in iron loading and/or metabolism (Finkenstedt et al., 2008. British Journal of Haematology. 144:789-93, the contents of which are herein incorporated by reference in their entirety.) Transcription of the gene encoding GDF-15 may be upregulated under stress and/or hypoxic conditions. In some cases, compounds and/or compositions of the present invention may be used to treat subjects suffering from iron disorders and/or anemias by altering GDF-15 signaling activity. Such compounds and/or compositions may comprise antibodies capable of stabilizing or destabilizing the GDF-15 GPC or through modulation of one or more interaction between GDF-15 and one or more co-factor.

Hemochromatosis is a disease characterized by iron overload due to hyperabsorption of dietary iron. In hereditary hemochromatosis (HH,) this overload is caused by inheritance of a common autosomal recessive copy of the HFE gene from both parents. In such cases, iron may be overloaded in plasma as well as in organs and tissues, including, but not limited to the pancreas, liver and skin, leading to damage caused by iron deposits (Tussing-Humphreys et al, 2013.) Current therapies for HH may include phlebotomy, multiple times per year. In some embodiments, compounds and/or compositions of the present invention may be used to treat HH by modulating subject iron levels.

Mutations in the hepcidin (HAMP) and/or hemojuvelin (HFE2) genes are responsible for a severe form of hemochromatosis known as juvenile hemochromatosis (Roetto et al., 2003; Papanikolauou et al., 2004.) Some mutations of hemojuvelin associated with juvenile hemochromatosis lead to protein misfolding and reduce hemojuvelin secretion from the cell, thus decreasing overall hemojuvelin signaling activity. Other mutations affect hemojuvelin interactions with other signaling molecules. Hemojuvelin comprising the mutation G99R, for example, is unable to bind BMP-2. Hemojuvelin comprising the mutation L101P is unable to associate with either BMP-2 or neogenin. Some therapeutic embodiments of the present invention may comprise the modulation of hemojuvelin signaling.

During chemotherapy, cell division is temporarily halted to prevent the growth and spread of cancerous cells. An unfortunate side effect is the loss of red blood cells which depend on active cell division of bone marrow cells. In some embodiments, compounds and/or compositions of the present invention may be used to treat anemia associated chemotherapy.

In some cases, compounds and/or compositions of the present invention may be combined with any of the therapeutics described herein to increase efficacy.

Therapeutics for Anemia, Thrombocytopenia and Neutropenia

During chemotherapy, cell division is temporarily halted to prevent the growth and spread of cancerous cells. An unfortunate side effect is the loss of red blood cells, platelets and white blood cells which depend on active cell division of bone marrow cells. In some embodiments, compounds and/or compositions of the present invention may be designed to treat patients suffering from anemia (the loss of red blood cells), thrombocytopenia (a decrease in the number of platelets) and/or neutropenia (a decrease in the number of neutrophils).

Therapeutics for Cancer

Various cancers may be treated with compounds and/or compositions of the present invention. As used herein, the term "cancer" refers to any of various malignant neoplasms characterized by the proliferation of anaplastic cells that tend to invade surrounding tissue and metastasize to new body sites and also refers to the pathological condition characterized by such malignant neoplastic growths. Cancers may be tumors or hematological malignancies, and include but are not limited to, all types of lymphomas/leukemias, carcinomas and sarcomas, such as those cancers or tumors found in the anus, bladder, bile duct, bone, brain, breast, cervix, colon/rectum, endometrium, esophagus, eye, gallbladder, head and neck, liver, kidney, larynx, lung, mediastinum (chest), mouth, ovaries, pancreas, penis, prostate, skin, small intestine, stomach, spinal marrow, tailbone, testicles, thyroid and uterus.

In cancer, TGF-β may be either growth promoting or growth inhibitory. As an example, in pancreatic cancers, SMAD4 wild type tumors may experience inhibited growth in response to TGF-β, but as the disease progresses, constitutively activated type II receptor is typically present. Additionally, there are SMAD4-null pancreatic cancers. In some embodiments, compounds and/or compositions of the present invention are designed to selectively target components of TGF-β signaling pathways that function uniquely in one or more forms of cancer. Leukemias, or cancers of the blood or bone marrow that are characterized by an abnormal proliferation of white blood cells i.e., leukocytes, can be divided into four major classifications including Acute lymphoblastic leukemia (ALL), Chronic lymphocytic leukemia (CLL), Acute myelogenous leukemia or acute myeloid leukemia (AML) (AML with translocations between chromosome 10 and 11 [t(10, 11)], chromosome 8 and 21 [t(8; 21)], chromosome 15 and 17 [t(15; 17)], and inversions in chromosome 16 [inv (16)]; AML with multilineage dysplasia, which includes patients who have had a prior myelodysplastic syndrome (MDS) or myeloproliferative disease that transforms into AML; AML and myelodysplastic syndrome (MDS), therapy-related, which category includes patients who have had prior chemotherapy and/or radiation and subsequently develop AML or MDS; d) AML not otherwise categorized, which includes subtypes of AML that do not fall into the above categories; and e) Acute leukemias of ambiguous lineage, which occur when the leukemic cells cannot be classified as either myeloid or lymphoid cells, or where both types of cells are present); and Chronic myelogenous leukemia (CML).

The types of carcinomas include, but are not limited to, papilloma/carcinoma, choriocarcinoma, endodermal sinus tumor, teratoma, adenoma/adenocarcinoma, melanoma, fibroma, lipoma, leiomyoma, rhabdomyoma, mesothelioma, angioma, osteoma, chondroma, glioma, lymphoma/leukemia, squamous cell carcinoma, small cell carcinoma, large cell undifferentiated carcinomas, basal cell carcinoma and sinonasal undifferentiated carcinoma.

The types of sarcomas include, but are not limited to, soft tissue sarcoma such as alveolar soft part sarcoma, angiosarcoma, dermatofibrosarcoma, desmoid tumor, desmoplastic small round cell tumor, extraskeletal chondrosarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, synovial sarcoma, and Askin's tumor, Ewing's sarcoma (primitive neuroectodermal tumor), malignant hemangioendothelioma, malignant schwannoma, osteosarcoma, and chondrosarcoma.

In some embodiments, compositions and methods of the invention may be used to treat one or more types of cancer or cancer-related conditions that may include, but are not limited to colon cancer, renal cancer, breast cancer, malignant melanoma and glioblastomas (Schlingensiepen et al., 2008; Ouhtit et al., 2013.)

High-grade gliomas (e.g. anaplastic astrocytomas and glioblastomas) make up around 60% of malignant brain tumors. TGF-β2 has been found to be overexpressed in over 90% of such gliomas and expression levels correlate with tumor progression. Further, studies using TGF-β2 reduction at the mRNA level in cancer patients showed significant improvement in tumor outcome (Bogdahn et al., 2010.) In light of these studies, some compositions of the present invention may be used therapeutically to treat individuals with high-grade gliomas. Such compositions may act to lower the levels of free TGF-β2 and/or the levels of TGF-β2 activity.

In some cases, TGF-β2 activity may contribute to tumor development through modulation of metastasis, angiogenesis, proliferation and/or immunosuppressive functions that impair immunological tumor surveillance (Schlingensiepen et al., 2008.) A study by Reed et al (Reed et al., 1994) demonstrated TGF-β2 mRNA expression in a large percentage of melanocytic lesions including primary invasive melanomas and metastatic melanomas. Some compounds and/or compositions of the present invention may be used to modulate TGF-β2 activity and/or levels in such lesions and or prevent lesion formation. Melanoma cell growth in the brain parenchyma has also been shown to be influenced by TGF-β2 activity (Zhang et al., 2009.) Some compounds and/or compositions of the present invention may be used to prevent or control such cell growth through modulation of TGF-β2 activity and/or levels.

Among females worldwide, breast cancer is the most prevalent form of cancer. Breast cancer metastasis is mediated in part through interactions between cancer cells and extracellular matrix components, such as hyaluronic acid (HA.) CD44 has been shown to be the major receptor for HA on cancer cells (Ouhtit et al., 2013.) The interaction between CD44 and HA leads to modulation of cell motility, survival adhesion and proliferation. TGF-β2 transcription is also upregulated by CD44 signaling activity and is believe to contribute to resulting changes in cell motility. Unfortunately, current therapies have limited efficacy and many carry adverse effects due to a lack of specificity. In some cases, compounds and/or compositions of the present invention may be used to alter cellular activities induced by TGF-β2 upregulation.

The invention further relates to the use of compounds and/or compositions of the present invention for treating one or more forms of cancer, in combination with other pharmaceuticals and/or other therapeutic methods, e.g., with known pharmaceuticals and/or known therapeutic methods, such as, for example, those which are currently employed for treating these disorders. For example, the compounds and/or compositions of the present invention can also be administered in conjunction with one or more additional anti-cancer treatments, such as biological, chemotherapy and radiotherapy. Accordingly, a treatment can include, for example, imatinib (Gleevac), all-trans-retinoic acid, a monoclonal antibody treatment (gemtuzumab, ozogamicin), chemotherapy (for example, chlorambucil, prednisone, prednisolone, vincristine, cytarabine, clofarabine, farnesyl transferase inhibitors, decitabine, inhibitors of MDR1), rituximab, interferon-α, anthracycline drugs (such as daunorubicin or idarubicin), L-asparaginase, doxorubicin, cyclophosphamide, doxorubicin, bleomycin, fludarabine, etoposide, pentostatin, or cladribine), bone marrow transplant, stem cell transplant, radiation therapy, anti-metabolite drugs (methotrexate and 6-mercaptopurine), or any combination thereof.

Radiation therapy (also called radiotherapy, X-ray therapy, or irradiation) is the use of ionizing radiation to kill cancer cells and shrink tumors. Radiation therapy can be administered externally via external beam radiotherapy (EBRT) or internally via brachytherapy. The effects of radiation therapy are localized and confined to the region being treated. Radiation therapy may be used to treat almost every type of solid tumor, including cancers of the brain, breast, cervix, larynx, lung, pancreas, prostate, skin, stomach, uterus, or soft tissue sarcomas. Radiation is also used to treat leukemia and lymphoma.

Chemotherapy is the treatment of cancer with drugs that can destroy cancer cells. In current usage, the term "chemotherapy" usually refers to cytotoxic drugs which affect rapidly dividing cells in general, in contrast with targeted therapy. Chemotherapy drugs interfere with cell division in various possible ways, e.g. with the duplication of DNA or the separation of newly formed chromosomes. Most forms of chemotherapy target all rapidly dividing cells and are not specific to cancer cells, although some degree of specificity may come from the inability of many cancer cells to repair DNA damage, while normal cells generally can.

Most chemotherapy regimens are given in combination. Exemplary chemotherapeutic agents include, but are not limited to, 5-FU Enhancer, 9-AC, AG2037, AG3340, Aggrecanase Inhibitor, Aminoglutethimide, Amsacrine (m-AMSA), Asparaginase, Azacitidine, Batimastat (BB94), BAY 12-9566, BCH-4556, Bis-Naphtalimide, Busulfan, Capecitabine, Carboplatin, Carmustaine+Polifepr Osan, cdk4/cdk2 inhibitors, Chlorombucil, CI-994, Cisplatin, Cladribine, CS-682, Cytarabine HCl, D2163, Dactinomycin, Daunorubicin HCl, DepoCyt, Dexifosamide, Docetaxel, Dolastain, Doxifluridine, Doxorubicin, DX8951f, E 7070, EGFR, Epirubicin, Erythropoietin, Estramustine phosphate sodium, Etoposide (VP16-213), Farnesyl Transferase Inhibitor, FK 317, Flavopiridol, Floxuridine, Fludarabine, Fluorouracil (5-FU), Flutamide, Fragyline, Gemcitabine, Hexamethylmelamine (HMM), Hydroxyurea (hydroxycarbamide), Ifosfamide, Interferon Alfa-2a, Interferon Alfa-2b, Interleukin-2, Irinotecan, ISI 641, Krestin, Lemonal DP 2202, Leuprolide acetate (LHRH-releasing factor analogue), Levamisole, LiGLA (lithium-gamma linolenate), Lodine Seeds, Lometexol, Lomustine (CCNU), Marimistat, Mechlorethamine HCl (nitrogen mustard), Megestrol acetate, Meglamine GLA, Mercaptopurine, Mesna, Mitoguazone (methyl-GAG; methyl glyoxal bis-guanylhydrazone; MGBG), Mitotane (o.p'-DDD), Mitoxantrone, Mitoxantrone HCl, MMI 270, MMP, MTA/LY 231514, Octreotide, ODN 698, OK-432, Oral Platinum, Oral Taxoid, Paclitaxel (TAXOL®), PARP Inhibitors, PD 183805, Pentostatin (2' deoxycoformycin), PKC 412, Plicamycin, Procarbazine HCl, PSC 833, Ralitrexed, RAS Farnesyl Transferase Inhibitor, RAS Oncogene Inhibitor, Semustine (methyl-CCNU), Streptozocin, Suramin, Tamoxifen citrate, Taxane Analog, Temozolomide, Teniposide (VM-26), Thioguanine, Thiotepa, Topotecan, Tyrosine Kinase, UFT (Tegafur/Uracil), Valrubicin, Vinblastine sulfate, Vindesine sulfate, VX-710, VX-853, YM 116, ZD 0101, ZD 0473/Anormed, ZD 1839, ZD 9331.

Biological therapies use the body's immune system, either directly or indirectly, to fight cancer or to lessen the side effects that may be caused by some cancer treatments. In some embodiments, compounds and/or compositions of the present invention may be considered biological therapies in that they may stimulate immune system action against one or more tumor, for example. However, this approach may also be considered with other such biological approaches, e.g., immune response modifying therapies such as the administration of interferons, interleukins, colony-stimulating factors, other monoclonal antibodies, vaccines, gene therapy, and nonspecific immunomodulating agents are also envisioned as anti-cancer therapies to be combined with the compounds and/or compositions of the present invention.

Small molecule targeted therapy drugs are generally inhibitors of enzymatic domains on mutated, overexpressed, or otherwise critical proteins within the cancer cell, such as tyrosine kinase inhibitors imatinib (Gleevec/Glivec) and gefitinib (Iressa). Examples of monoclonal antibody therapies that can be used with compounds and/or compositions of the present invention include, but are not limited to, the anti-HER2/neu antibody trastuzumab (Herceptin) used in breast cancer, and the anti-CD20 antibody rituximab, used in a variety of B-cell malignancies. The growth of some cancers can be inhibited by providing or blocking certain hormones. Common examples of hormone-sensitive tumors include certain types of breast and prostate cancers. Removing or blocking estrogen or testosterone is often an important additional treatment. In certain cancers, administration of hormone agonists, such as progestogens may be therapeutically beneficial.

Cancer immunotherapy refers to a diverse set of therapeutic strategies designed to induce the patient's own immune system to fight the tumor, and include, but are not limited to, intravesical BCG immunotherapy for superficial bladder cancer, vaccines to generate specific immune responses, such as for malignant melanoma and renal cell carcinoma, and the use of Sipuleucel-T for prostate cancer, in which dendritic cells from the patient are loaded with prostatic acid phosphatase peptides to induce a specific immune response against prostate-derived cells.

In some embodiments, compounds and/or compositions of the present invention are designed to prevent T cell inhibition. Such compounds and/or compositions may prevent the dissociation of growth factors from the prodomain of the GPC or from extracellular matrix and/or cellular matrix components including, but not limited to GARPs, fibrillins or LTBPs.

Therapeutics for Bone Healing

Compounds and/or compositions of the present invention may be used to treat bone disorders and/or improve bone healing or repair. Cellular remodeling of bone is a lifelong process that helps to maintain skeletal integrity. This process involves cycles of osteoclastic bone resorption and new bone formation that function to repair defects and areas of weakness in bone. TGF-beta family members, preferably BMPs, are thought to be important factors in coupling the processes of resorption and formation by osteoclasts. TGF-beta family members are prevalent in the bone matrix and upregulated by bone injury. TGF-beta family members are also believed to impart strength to the fully formed bone matrix, imparting resistance to fracture. The role of TGF-beta family members in bone remodeling makes them attractive targets for potential therapeutics to treat bone disorder and disease.

Numerous diseases and/or disorders affect bones and joints. Such diseases and/or disorders may be congenital, genetic and/or acquired. Such diseases and/or disorders include, but are not limited to, bone cysts, infectious arthritis, Paget's disease of the bone, Osgood-Schlatter disease, Kohler's bone disease, bone spurs (osteophytes), bone tumors, craniosynostosis, fibrodysplasia ossificans progressive, fibrous dysplasia, giant cell tumor of bone, hypophosphatasia, Klippel-Feil syndrome, metabolic bone disease, osteoarthritis, osteitis deformans, osteitis fibrosa cystica, osteitis pubis, condensing osteitis, osteitis condensans ilii, osteochondritis dissecans, osteochondroma, osteogenesis imperfecta, osteomalacia, osteomyelitis, osteopenia, osteopetrosis, osteoporosis, osteosarcoma, porotic hyperostosis, primary hyperparathyroidism, renal osteodystrophy and water on the knee.

Mouse models for evaluating the effectiveness of therapeutics on bone development and repair are well known in the art. In one such model demonstrated by Mohammad, et al. (Mohammad, K. S. et al., *Pharmacologic inhibition of the TGF-beta type I receptor kinase has anabolic and anti-catabolic effects on bone*. PLoS One. 2009; 4(4):e5275. Epub 2008 Apr. 16), inhibition of the TGF-beta type I receptor was carried out in C57Bl/6 mice through twice daily administration of a potent inhibitor, SD-208, by gavage. Subsequently, bone mineral density (BMD) was analyzed using a PIXImus mouse densitometer (GE Lunar II, Faxitron Corp., Wheeling, Ill.). Changes in BMD are expressed as a percentage change in the area scanned. The study found that after 6 weeks of treatment, male mice exhibited a 4.12% increase in bone accrual while female mice exhibited a 5.2% increase.

Compounds and/or compositions of the present invention may be useful as therapies for simple or complex bone fractures and/or bone repair. In such treatments, compounds and/or compositions of the present invention may be introduced to the site of injury directly or through the incorporation into implantation devices and coated biomatrices. Additionally, treatments are contemplated in which compounds and/or compositions of the present invention are supplied together with one or more GPC in a treatment area, facilitating the slow release of one or more growth factors from such GPCs.

Therapeutics for Angiogenic and Endothelial Proliferation Conditions

The compounds and/or compositions of the present invention may be used to treat angiogenic and endothelial proliferation syndromes, diseases or disorders. The term "angiogenesis", as used herein refers to the formation and/or reorganization of new blood vessels. Angiogenic disease involves the loss of control over angiogenesis in the body. In such cases, blood vessel growth, formation or reorganization may be overactive (including during tumor growth and cancer where uncontrolled cell growth requires increased blood supply) or insufficient to sustain healthy tissues. Such conditions may include, but are not limited to angiomas, angiosarcomas, telangiectasia, lymphangioma, congenital vascular anomalies, tumor angiogenesis and vascular structures after surgery. Excessive angiogenesis is noted in cancer, macular degeneration, diabetic blindness, rheumatoid arthritis, psoriasis as well as many other conditions. Excessive angiogenesis is often promoted by excessive angiogenic growth factor expression. Compounds and/or compositions of the present invention may act to block growth factors involved in excessive angiogenesis. Alternatively, compounds and/or compositions of the present invention may be utilized to promote growth factor signaling to enhance angiogenesis in conditions where angiogenesis is inhibited. Such conditions include, but are not limited to coronary artery disease, stroke, diabetes and chronic wounds.

Therapeutics for Orphan Indications and Diseases

The compounds and/or compositions of the present invention may be used to treat orphan indications and/or diseases. Such diseases include Marfan's syndrome. This syndrome is a connective tissue disorder, effecting bodily growth and development. Tissues and organs that are most severely compromised include the heart, blood vessels, bones, eyes, lungs and connective tissue surrounding the spinal cord. Unfortunately, the effects can be life threatening. Marfan's syndrome is caused by a genetic mutation in the gene that produces fibrillin, a major component of bodily connective tissue. Latent TGF-β binding protein (LTBP) is an important regulator of TGF-β signaling that exhibits close identity to fibrillin protein family members. Functional LTBP is required for controlling the release of active TGF-β (Oklu, R. et al., The latent transforming growth factor beta binding protein (LTBP) family. Biochem J. 2000 Dec. 15; 352 Pt 3:601-10). In some embodiments, compounds and/or compositions of the present invention are designed to alter the release profile of TGF-β. In such embodiments, compounds and/or compositions may comprise antibodies characterized as inhibitory antibodies.

In some embodiments, compounds and/or compositions of the present invention may be useful in the treatment of Camurati-Engelmann disease (CED). This disease primarily affects the bones, resulting in increased bone density. Especially affected are the long bones of the legs and arms; however, the bones of the skill and hips can also be affected. The disease results in leg and arm pain as well as a variety of other symptoms. CED is very rare, reported in approximately 200 individuals worldwide and is caused by a mutation in the TGF-β gene. TGF-β produced in the bodies of these individuals has a defective prodomain, leading to overactive TGF-β signaling (Janssens, K. et al., Transforming growth factor-beta 1 mutations in Camurati-Engelmann disease lead to increased signaling by altering either activation or secretion of the mutant protein. J Biol Chem. 2003 Feb. 28; 278(9): 7718-24. Epub 2002 Dec. 18). As described by Shi et al., (Shi, M. et al., Latent TGF-beta structure and activation. Nature. 2011 Jun. 15; 474(7351):343-9,) among CED mutations, Y81H disrupts an α2-helix residue that cradles the TGF-β fingers. The charge-reversal E169K and H222D mutations disrupt a pH-regulated salt bridge between Glu 169 and His 222 in the dimerization interface of the prodomain. Residue Arg 218 is substantially buried: it forms a cation-π bond with Tyr 171 and salt bridges across the dimer interface with residue Asp 226 of the 'bowtie' region of the growth factor prodomain complex (GPC). Moreover, CED mutations in Cys 223 and Cys 225 demonstrate the importance of disulphide bonds in the bowtie region for holding TGF-β in inactive form. In this embodiment, compounds and/or compositions of the present invention comprising one or more inhibitory antibodies would serve to alleviate symptoms. In some embodiments, administration would be to the neonate subject.

Therapeutics for Immune and Autoimmune Diseases and Disorders

Compounds and/or compositions of the present invention may be used to treat immune and autoimmune disorders. Such disorders include, but are not limited to Acute Disseminated Encephalomyelitis (ADEM), Acute necrotizing hemorrhagic leukoencephalitis, Addison's disease, Agammaglobulinemia, Alopecia areata, Amyloidosis, Ankylosing spondylitis, Anti-GBM/Anti-TBM nephritis, Antiphospholipid syndrome (APS), Autoimmune angioedema, Autoimmune aplastic anemia, Autoimmune dysautonomia, Autoimmune hepatitis, Autoimmune hyperlipidemia, Autoimmune immunodeficiency, Autoimmune inner ear disease (AIED), Autoimmune myocarditis, Autoimmune pancreatitis, Autoimmune retinopathy, Autoimmune thrombocytopenic purpura (ATP), Autoimmune thyroid disease, Autoimmune urticaria, Axonal & neuronal neuropathies, Balo disease, Behcet's disease, Bullous pemphigoid, Cardiomyopathy, Castleman disease, Celiac disease, Chagas disease, Chronic fatigue syndrome, Chronic inflammatory demyelinating polyneuropathy (CIDP), Chronic recurrent multifocal ostomyelitis (CRMO), Churg-Strauss syndrome, Cicatricial pemphigoid/benign mucosal pemphigoid, Crohn's disease, Cogans syndrome, Cold agglutinin disease, Congenital heart block, Coxsackie myocarditis, CREST disease, Essential mixed cryoglobulinemia, Demyelinating neuropathies, Dermatitis herpetiformis, Dermatomyositis, Devic's disease (neuromyelitis optica), Diabetes Type I, Discoid lupus, Dressler's syndrome, Endometriosis, Eosinophilic esophagitis, Eosinophilic fasciitis, Erythema nodosum, Experimental allergic encephalomyelitis, Evans syndrome, Fibromyalgia, Fibrosing alveolitis, Giant cell arteritis (temporal arteritis), Glomerulonephritis, Goodpasture's syndrome, Granulomatosis with Polyangiitis (GPA) see Wegener's, Graves' disease, Guillain-Barre syndrome, Hashimoto's encephalitis, Hashimoto's thyroiditis, Hemolytic anemia, Henoch-Schonlein purpura, Herpes gestationis, Hypogammaglobulinemia, Idiopathic thrombocytopenic purpura (ITP), IgA nephropathy, IgG4-related sclerosing disease, Immunoregulatory lipoproteins, Inclusion body myositis, Insulin-dependent diabetes (typel), Interstitial cystitis, Juvenile arthritis, Juvenile diabetes, Kawasaki syndrome, Lambert-Eaton syndrome, Large vessel vasculopathy, Leukocytoclastic vasculitis, Lichen planus, Lichen sclerosus, Ligneous conjunctivitis, Linear IgA disease (LAD), Lupus (SLE), Lyme disease, chronic, Meniere's disease, Microscopic polyangiitis, Mixed connective tissue disease (MCTD), Mooren's ulcer, Mucha-Habermann disease, Multiple endocrine neoplasia syndromes, Multiple sclerosis, Myositis, Myasthenia gravis, Narcolepsy, Neuromyelitis optica (Devic's), Neutropenia, Ocular cicatricial pemphigoid, Optic neuritis, Palindromic rheumatism, PANDAS (Pediatric Autoimmune Neuropsychiatric Disorders Associated with *Streptococcus*), Paraneoplastic cerebellar degeneration, Paroxysmal nocturnal hemoglobinuria (PNH), Parry Romberg syndrome, Parsonnage-Turner syndrome, Pars planitis (peripheral uveitis), Pemphigus, Peripheral neuropathy, Perivenous encephalomyelitis, Pernicious anemia, POEMS syndrome, Polyarteritis nodosa, Type I, II, & III autoimmune polyglandular syndromes, Polyendocrinopathies, Polymyalgia rheumatica, Polymyositis, Postmyocardial infarction syndrome, Postpericardiotomy syndrome, Progesterone dermatitis, Primary biliary cirrhosis, Primary sclerosing cholangitis, Psoriasis, Psoriatic arthritis, Idiopathic Pulmonary fibrosis, Pyoderma gangrenosum, Pure red cell aplasia, Raynauds phenomenon, Reactive arthritis, Reflex sympathetic dystrophy, Reiter's syndrome, Relapsing polychondritis, Restless legs syndrome, Retroperitoneal fibrosis, Rheumatic fever, Rheumatoid arthritis, Sarcoidosis, Schmidt syndrome, Scleritis, Scleroderma, Sjogren's syndrome, Small vessel vasculopathy, Sperm & testicular autoimmunity, Stiff person syndrome, Subacute bacterial endocarditis (SBE), Susac's syndrome, Sympathetic ophthalmia, Takayasu's arteritis, Temporal arteritis/Giant cell arteritis, Thrombocytopenic purpura (TTP), Tolosa-Hunt syndrome, Transverse myelitis, Tubular autoimmune disorder, Ulcerative colitis, Undifferentiated connective tissue disease (UCTD), Uveitis, Vesiculobullous dermatosis, Vasculitis, Vitiligo and Wegener's granulomatosis (also known as Granulomatosis with Polyangiitis (GPA)).

TGF-β plays an active role in leukocyte differentiation, proliferation and activation making it an important factor in immune and autoimmune diseases. Additionally, TGF-β promotes chemotaxis of leukocytes and influences adhesion molecule-mediated localization. A role for TGF-β in cardiac, pulmonary and gastric inflammation has been demonstrated. Furthermore, SMAD3-deficient mice are prone to chronic mucosal infections as a result of T-cell activation impairment and reduced mucosal immunity (Blobe, G. C. et al., Role of transforming growth factor beta in human disease. N Engl J Med. 2000 May 4; 342(18):1350-8). As an immunosuppressant, TGF-β has been shown to both inhibit the function of inflammatory cells as well as enhance the function of regulatory T cells. Recent studies have shown that the latent TGF-β growth factor prodomain complex (GPC) binds to regulatory T cells through an interaction with the Glycoprotein-A repetitions anonymous protein (GARP). In fact, GARP is necessary for TGF-β association with T cells (Tran, D. Q. et al., GARP (LRRC32) is essential for the surface expression of latent TGF-β on platelets and activated $FOXP3^+$ regulatory T cells. PNAS. 2009. 106(32):13445-50). This interaction provides the platform necessary to release active TGF-β from the GPC in an integrin-dependent manner (Wang, R. et al., GARP regulates the bioavailability and activation of TGF-β. Mol Biol Cell. 2012 March; 23(6):1129-39. Epub 2012 Jan. 25). In some embodiments, compounds and/or compositions of the present invention modulate the interaction between GARP and TGF-β. Such modulation may selectively modulate T cell activity for treatment of disease (e.g. autoimmune disease and/or cancer.) In some embodiments, compounds and/or compositions of the present invention may be used for the treatment of immune and/or autoimmune disorders. In some embodiments, compounds and/or compositions of the present invention may specifically target GARP-bound GPC, GARP or the interaction site between GARP and the GPC. In some embodiments, compounds and/or compositions of the present invention comprising antibodies are designed to promote release of growth factors (including, but not limited to TGF-β) from GARP-bound GPCs while not affecting growth factor release from LTBP-bound GPCs. Treatment of immune and autoimmune disorders with compounds and/or compositions of the present invention may be in combination with standard of care (SOC) or synergistic combinations or with companion diagnostics.

Therapeutics for Infectious Agents

In some embodiments, compounds and/or compositions of the present invention may be useful for treatment of infectious diseases and/or disorders, for example, in subjects with one or more infections. In some embodiments, subjects have one or more infection or are at risk of developing one or more infection. As used herein, the term "infection" refers to a disease or condition in a host attributable to the presence of one or more foreign organism or agent capable of reproduction within the host. Infections typically comprise breaching of one or more normal mucosal or other tissue barriers by one or more infectious organisms or agents. Subjects having one or more infection are subjects that comprise one or more objectively measurable infectious organisms or agents present in their body. Subjects at risk of having one or more infection are subjects that are predisposed to developing one or more infection. Such subjects may include, for example, subjects with known or suspected exposure to one or more infectious organisms or agents. In some embodiments, subjects at risk of having infections may also include subjects with conditions associated with impaired abilities to mount immune responses to infectious organisms and/or agents, e.g., subjects with congenital and/or acquired immunodeficiency, subjects undergoing radiation therapy and/or chemotherapy, subjects with burn injuries, subjects with traumatic injuries and subjects undergoing surgery or other invasive medical or dental procedures.

Infections are broadly classified as bacterial, viral, fungal, and/or parasitic based on the category of infectious organisms and/or agents involved. Other less common types of infection are also known in the art, including, e.g., infections involving rickettsiae, mycoplasmas, and agents causing scrapie, bovine spongiform encephalopathy (BSE), and prion diseases (e.g., kuru and Creutzfeldt-Jacob disease). Examples of bacteria, viruses, fungi, and parasites which cause infection are well known in the art. An infection can be acute, subacute, chronic, or latent, and it can be localized or systemic. As used herein, the term "chronic infection" refers to those infections that are not cleared by the normal actions of the innate or adaptive immune responses and persist in the subject for a long duration of time, on the order of weeks, months, and years. A chronic infection may reflect latency of the infectious agent, and may include periods in which no infectious symptoms are present, i.e., asymptomatic periods. Examples of chronic infections include, but are not limited to, HIV infection and herpesvirus infections. Furthermore, an infection can be predominantly intracellular or extracellular during at least one phase of the infectious organism's or agent's life cycle in the host.

Compounds and/or compositions of the present invention and additional therapeutic agents may be administered in combination in the same composition (e.g., parenterally), as part of a separate composition or by another method described herein.

Therapeutics for Eye Related Diseases, Disorders and/or Conditions

In some embodiments, compounds and/or compositions of the present invention may be useful in the treatment of diseases, disorders and/or conditions related to eyes. These may include, but are not limited to glaucoma, dry eye and/or corneal wound healing. In some embodiments, compounds and/or compositions may be useful in the treatment of glaucoma. Evidence suggests that TGF-β2 is upregulated in glaucoma (Picht, G. et al., Transforming growth factor beta 2 levels in the aqueous humor in different types of glaucoma and the relation to filtering bleb development. Graefes Arch Clin Exp Ophthalmol. 2001 March 239(3):199-207; Tripathi, R. C. et al., Aqueous humor in glaucomatous eyes contains an increased level of TGF-β2. Exp Eye Res. 1994 December 59(6):723-7.) This includes primary open-angle glaucoma and juvenile glaucoma. There is also evidence that TGF-β2 may induce senescence-like effects in human trabecular meshwork cells, which control intraocular pressure (often dysfunctional in glaucoma) (Yu, A. L. et al., TGF-β2 induces senescence-associated changes in human trabecular meshwork cells. Invest Ophthalmol Vis Sci. 2010 November 51(11): 5718-23.) In some embodiments, compounds and/or compositions of the present invention may be used to decrease the ratio of free TGF-β2 to GPC-bound (inactive) TGF-β2 in or around eye tissues affected by or related to glaucoma. TGF-β-related proteins may also impact on corneal wound healing (e.g. after surgical repair and/or LASIK treatment) (Huh, M. I. et al., Distribution of TGF-β isoforms and signaling intermediates in corneal fibrotic wound repair. J Cell Biochem. 2009 Oct. 1. 108(2): 476-88; Sumioka, T. et al., Inhibitory effect of blocking TGF-beta/Smad signal on injury-induced fibrosis of corneal endothelium. Mol Vis. 2008; 14:2272-81. Epub 2008 Dec. 11; Carrington, L. M. et al., Differential regulation of key stages in early corneal wound healing by TGF-beta isoforms and their inhibitors. Invest Ophthalmol Vis Sci. 2006 May; 47(5):1886-94.) Compounds and/or compositions of the present invention may be used to modulate TGF-β-related proteins in the cornea to enable and/or enhance wound healing. Such compounds and/or compositions would be welcomed in the field where previous attempts have been unsuccessful. Mead et al (Mead, A. L. et al., Evaluation of anti-TGF-beta2 antibody as a new postoperative anti-scarring agent in glaucoma surgery. Invest Ophthalmol Vis Sci. 2003 August; 44(8):3394-401) developed anti-TGF-β2 antibodies to prevent scarring in eye tissues; however, results of clinical trials were inconclusive. In some embodiments, compounds and/or compositions of the present invention may be used to modulate TGF-β2 levels (free versus GPC-bound) thereby providing an alternate method of approaching anti-scarring therapy.

Therapeutics for Cardiovascular Indications

In some embodiments, compounds and/or compositions of the present invention may be used to treat one or more cardiovascular indications, including, but not limited to cardiac hypertrophy. Cardiac hypertrophy comprises enlargement of the heart due, typically due to increased cell volume of cardiac cells (Aurigemma 2006. N Engl J Med. 355(3):308-10.) Age-related cardiac hypertrophy may be due, in part, to reduced circulating levels of GDF-11. A study by Loffredo et al (Loffredo et al., 2013. Cell. 153:828-39) found that fusion of the circulatory system between young and old mice had a protective effect with regard to cardiac hypertrophy. The study identified GDF-11 as a circulating factor that decreased with age in mice and was able to show that its administration could also reduce cardiac hypertrophy. Some compounds and/or compositions of the present invention may be used to treat and/or prevent cardiac atrophy. Such compounds and/or compositions may comprise GDF-11 agonists that elevate levels of circulating GDF-11, in some cases through enhancing the dissociation of GDF-11 growth factor from latent GPCs.

In some embodiments, compositions and methods of the invention may be used to treat one or more types of arterial disorders. Such disorders may include, but are not limited to the development of aortic aneurysms. Aortic aneurysms may arise from a variety of causes, but most result ultimately in the overexpression of TGF-β2. A study by Boileau et al (Boileau et al., Nature Genetics Letters. 2012. 44(8):916-23, the contents of which are herein incorporated by reference in their entirety) uncovered causative mutations in TGF-β2 that were associated with some inherited forms of susceptibility to thoracic aortic disease. Interestingly, although the mutations were predicted to cause haploinsufficiency for TGF-β2, the aortic tissues of individuals with such mutations comprised increased levels of TGF-β2, as determined by immunostaining Similar findings were found in aortic tissues from individuals suffering from Marfans syndrome (Nataatmadja et al., 2006.) In some cases, compounds and/or compositions of the present invention may be used to reduce or prevent elevated TGF-β2 signaling in such instances thereby limiting aneurysm development and/or progression.

In some embodiments, animal models may be used to develop and test compounds and/or compositions of the present invention for use in the treatment of cardiovascular diseases, disorders and/or conditions. In some cases, vascular injury models may be used. Such models may include balloon injury models. In some cases, these may be carried out as described in Smith et al., 1999. Circ Res. 84(10):1212-22, the contents of which are herein incorporated by reference in their entirety.

Therapeutics Related to Muscle Disorders and/or Injuries

In some embodiments, compounds and/or compositions of the present invention may be used to treat one or more muscle disorders and/or injuries. In some cases, such compounds and/or composition may include, but are not limited to antibodies that modulate GDF-8, GDF-11 and/or activin activity. Muscle comprises about 40-50% of total body weight, making it the largest organ in the body. Muscle disorders may include cachexia (e.g. muscle wasting.) Muscle wasting may be associated with a variety of diseases and catabolic disorders (e.g. HIV/AIDS, cancer, cancer cachexia, renal failure, congestive heart failure, muscular dystrophy, disuse atrophy, chronic obstructive pulmonary disease, motor neuron disease, trauma, neurodegenerative disease, infection, rheumatoid arthritis, immobilization, diabetes, etc.) In such disorders, GDF-8 and/or activin signaling activity may contribute to muscle catabolism (Han et al., 2013. Int J Biochem Cell Biol. 45(10):2333-47; Lee., 2010. Immunol Endocr Metab Agents Med Chem. 10:183-94, the contents of each of which are herein incorporated by reference in their entirety.) Other muscle disorders may comprise sarcopenia. Sarcopenia is the progressive loss of muscle and function associated with aging. In the elderly, sarcopenia can cause frailty, weakness, fatigue and loss of mobility (Morely. 2012. Family Practice. 29:i44-i48.) With the aged population increasing in numbers, sarcopenia is progressively becoming a more serious public health concern. A study by Hamrick et al (Hamrick et al., 2010. 69(3):579-83) demonstrated that GDF-8 inhibition could repair muscle in a mouse model of fibula osteotomoy comprising lateral compartment muscle damage. Administration of GDF-8 propeptides was sufficient to increase muscle mass by nearly 20% as well as improve fracture healing. Some compounds and/or compositions of the present invention may be used to treat muscle diseases, disorders and/or injuries by modulating GDF-8 activity. In some cases, compounds of the present invention may be GDF-8 signaling antagonists, preventing or reducing GDF-8 signaling activity.

Inclusion body myositis (IBM) is a disease characterized by progressive muscle loss, typically occurring in mid- to late-life. The disease is thought to occur due to an autoimmune response to autoantigens in the muscle causing T-cell invasion of the muscle fiber and resulting in myofiber destruction (Greenberg 2012. Curr Opin Neurol. 25(5):630-9.) Therapeutic compounds are being investigated, including Bimagrumab (BYM338; Novartis, Basel, Switzerland,) an antibody that targets type II activin receptors, preventing GDF-8 and/or activin signal transduction, thereby stimulating muscle production and strengthening [see clinical trial number NCT01925209 entitled *Efficacy and Safety of Bimagrumab/BYM338 at 52 Weeks on Physical Function, Muscle Strength, Mobility in sIBM Patients (RESILIENT.)*] Some compounds and/or compositions of the present invention may be used to treat subjects with IBM. In some cases, such compounds and/or compositions may block GDF-8 activity (e.g. through stabilization of GDF-8 GPCs.) In addition to IBM, BYM338 is being investigated for treatment of chronic obstructive pulmonary disease (COPD.) In some cases, compounds and/or compositions of the present invention utilized for IBM treatment, may be used to treat COPD as well. In some cases, compounds and/or compositions of the present invention may be administered in combination and/or coordination with BYM338.

Therapeutics for Diabetes

Skeletal muscle uses and stores glucose for fuel. Due to this, skeletal muscle is an important regulator of circulating glucose levels. Uptake of glucose by muscle can be stimulated by either contraction or by insulin stimulation (McPherron et al., 2013. Adipocyte. 2(2):92-8, herein incorporated by reference in its entirety). A recent study by Guo et al (Guo, et al., 2012. Diabetes 61(10):2414-23) found that when GDF-8 receptor-deficient mice were crossed with A-ZIP/F1 mice (a lipodistrophic mouse strain, used as a diabetic model,) hybrid off-spring showed reduced levels of blood glucose and improved sensitivity to insulin. Hyperphagia (excessive eating) was also reduced in these mice. In some embodiments, compound and/or compositions of the present invention may be used to treat diabetes and/or hyperphagia. Some such treatments may be used to reduce blood glucose and/or improve insulin sensitivity. In some cases, such treatments may comprise GDF-8 signaling antagonists, such as one or more antibodies that prevent dissociation of GDF-8 from its prodomain.

Therapeutics for Gastro-Intestinal Diseases, Disorders and/or Conditions

In some embodiments, compositions and methods of the invention may be used to treat one or more types of gastro-intestinal (GI) disorders. Such disorders may include, but are not limited to inflammatory bowel disease (IBD) (e.g. Crohn's disease and ulcerative colitis.)

TGF-β2 may play a role in gut homeostasis and may have an anti-inflammatory role, protecting against GI-related disorders such as mucositis and certain forms of colitis. In one study, TGF-β2 was shown to suppress macrophage inflammatory responses in the developing intestine and protect against inflammatory mucosal injury (Maheshwari et al., 2011.) Interestingly, levels of TGF-β2 are high in breast milk, suggesting that TGF-β2 may function, in some cases, topically. Indeed, TGF-β2 in breast milk may attenuate inflammatory responses (Rautava et al., 2011.) Some compounds, compositions and/or methods of the present invention may be used to modulate GI TGF-β2 levels and/or activity in the maintenance of homeostasis and/or in the management of GI-related disorders.

In some cases, models of GI-related diseases, disorders and/or conditions may be used to develop and/or test compounds and/or compositions of the invention for treatment of GI-related diseases, disorders and/or conditions. In some cases, GI injury models may be used. Such injury models may include, but are not limited to 2,4,6-trinitrobenzenesulfonic acid (TNBS) induced colitis models. Such models may be carried out as described in Scheiffele, F. et al., 2002. Curr Protoc Immunol. Chapter 15:Unit 15.19, the contents of which are herein incorporated by reference in their entirety.

Veterinary Applications

In some embodiments, it is contemplated that compositions and methods of the invention will find utility in the area of veterinary care including the care and treatment of non-human vertebrates. As described herein, the term "vertebrate" includes all vertebrates including, but not limited to fish, amphibians, birds, reptiles and mammals (including, but not limited to alpaca, banteng, bison, camel, cat, cattle, deer, dog, donkey, gayal, goat, guinea pig, horse, llama, mice, monkeys, mule, pig, rabbit, rats, reindeer, sheep water buffalo, yak and humans.) As used herein the term "non-human vertebrate" refers to any vertebrate with the exception of humans (i.e. *Homo sapiens*). Exemplary non-human vertebrates include wild and domesticated species such as companion animals and livestock. Livestock include domesticated animals raised in an agricultural setting to produce materials such as food, labor, and derived products such as fiber and chemicals. Generally, livestock includes all mammals, avians and fish having potential agricultural significance. In particular, four-legged slaughter animals include steers, heifers, cows, calves, bulls, cattle, swine and sheep.

Bioprocessing

In some embodiments, the present invention provides methods for producing one or more biological products in host cells by contacting such cells with compounds and/or compositions of the present invention capable of modulating expression of target genes, or altering the level of growth factor signaling molecules wherein such modulation or alteration enhances production of biological products. According to the present invention, bioprocessing methods may be improved by using one or more compounds and/or compositions of the present invention. They may also be improved by supplementing, replacing or adding one or more compounds and/or compositions.

Pharmaceutical Compositions

The pharmaceutical compositions described herein may be characterized by one or more of bioavailability, therapeutic window and/or volume of distribution.

Bioavailability

In some embodiments, pharmaceutical compositions comprise complexes of compounds and/or compositions of the present invention with GPCs. In such embodiments, complexes may be implanted at desired therapeutic sites where steady dissociation of growth factors from complexes may occur over a desired period of time. In some embodiments, implantation complexes may be carried out in association with sponge and/or bone-like matrices. Such implantations may include, but are not limited to dental implant sites and/or sites of bone repair.

In some embodiments, compounds and/or compositions of the present invention are made in furin-deficient cells. GPCs produced in such cells may be useful for treatment in areas where release is slowed due to the fact that furin cleavage in vivo is rate-limiting during GPC processing. In some embodiments, one or more tolloid and/or furin sites in GPCs are mutated, slowing the action of endogenous tolloid and/or furin proteases. In such embodiments, growth factor release may be slowed (e.g. at sites of implantation.)

Antibodies of the present invention, when formulated into compositions with delivery/formulation agents or vehicles as described herein, may exhibit increased bioavailability as compared to compositions lacking delivery agents as described herein. As used herein, the term "bioavailability" refers to the systemic availability of a given amount of a particular agent administered to a subject. Bioavailability may be assessed by measuring the area under the curve (AUC) or the maximum serum or plasma concentration ($C_{max}$) of the unchanged form of a compound following administration of the compound to a mammal. AUC is a determination of the area under the curve plotting the serum or plasma concentration of a compound along the ordinate (Y-axis) against time along the abscissa (X-axis). Generally, the AUC for a particular compound may be calculated using methods known to those of ordinary skill in the art and as described in G. S. Banker, Modern Pharmaceutics, Drugs and the Pharmaceutical Sciences, v. 72, Marcel Dekker, New York, Inc., 1996, the contents of which are herein incorporated by reference in their entirety.

$C_{max}$ values are maximum concentrations of compounds achieved in serum or plasma of a subject following administration of compounds to the subject. $C_{max}$ values of particular compounds may be measured using methods known to those of ordinary skill in the art. As used herein, the phrases "increasing bioavailability" or "improving the pharmacokinetics," refer to actions that may increase the systemic availability of a compounds and/or compositions of the present invention (as measured by AUC, $C_{max}$, or $C_{min}$) in a subject. In some embodiments, such actions may comprise co-administration with one or more delivery agents as described herein. In some embodiments, the bioavailability of compounds and/or compositions may increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or about 100%.

Therapeutic Window

Compounds and/or compositions of the present invention, when formulated with one or more delivery agents as described herein, may exhibit increases in the therapeutic window of compound and/or composition administration as compared to the therapeutic window of compounds and/or compositions administered without one or more delivery agents as described herein. As used herein, the term "therapeutic window" refers to the range of plasma concentrations, or the range of levels of therapeutically active substance at the site of action, with a high probability of eliciting a therapeutic effect. In some embodiments, therapeutic windows of compounds and/or compositions when co-administered with one or more delivery agent as described herein may increase by at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95% or about 100%.

Volume of Distribution

Compounds and/or compositions of the present invention, when formulated with one or more delivery agents as described herein, may exhibit an improved volume of distribution ($V_{dist}$), e.g., reduced or targeted, relative to formulations lacking one or more delivery agents as described herein. $V_{dist}$ relates the amount of an agent in the body to the concentration of the same agent in the blood or plasma. As used herein, the term "volume of distribution" refers to the fluid volume that would be required to contain the total amount of an agent in the body at the same concentration as in the blood or plasma: $V_{dist}$ equals the amount of an agent in the body/concentration of the agent in blood or plasma. For example, for a 10 mg dose of a given agent and a plasma concentration of 10 mg/L, the volume of distribution would be 1 liter. The volume of distribution reflects the extent to which an agent is present in the extravascular tissue. Large volumes of distribution reflect the tendency of agents to bind to the tissue components as compared with plasma proteins. In clinical settings, $V_{dist}$ may be used to determine loading doses to achieve steady state concentrations. In some embodiments, volumes of distribution of compounds and/or compositions of the present invention when co-administered with one or more delivery agents as described herein may decrease at least about 2%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%.

Formulation, Administration, Delivery and Dosing

In some embodiments, compounds and/or compositions of the present invention are pharmaceutical compositions. As used herein, the term "pharmaceutical composition" refers to a compound and/or composition of the present invention that has been formulated with one or more pharmaceutically acceptable excipients. In some embodiments, pharmaceutical compositions may optionally comprise one or more additional active substances, e.g. therapeutically and/or prophylactically active substances. General considerations in the formulation and/or manufacture of pharmaceutical agents may be found, for example, in Remington: The Science and Practice of Pharmacy $21^{st}$ ed., Lippincott Williams & Wilkins, 2005 (incorporated herein by reference).

In some embodiments, compositions may be administered to humans, human patients or subjects. For the purposes of the present disclosure, the phrase "active ingredient" generally refers to compounds and/or compositions of the present invention to be delivered as described herein.

Although the descriptions of pharmaceutical compositions provided herein are principally directed to pharmaceutical compositions which are suitable for administration to humans, it will be understood by the skilled artisan that such compositions are generally suitable for administration to other subjects, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

In some embodiments, formulations of the pharmaceutical compositions described herein may be prepared by any method known or hereafter developed in the art of pharmacology. In general, such preparatory methods include the step of bringing active ingredients into association with excipients and/or one or more other accessory ingredients, and then, if necessary and/or desirable, dividing, shaping and/or packaging products into desired single- or multi-dose units.

In some embodiments, pharmaceutical compositions of the present invention may be prepared, packaged, and/or sold in bulk, as single unit doses, and/or as a plurality of single unit doses. As used herein, the term "unit dose" refers to a discrete amount of the pharmaceutical composition comprising a predetermined amount of active ingredient. Amounts of active ingredient are generally equal to the dosage of active ingredients which would be administered to subjects and/or convenient fractions of such a dosages such as, for example, one-half or one-third of such a dosages.

In some embodiments, relative amounts of active ingredients, pharmaceutically acceptable excipients, and/or any additional ingredients in pharmaceutical compositions of the present invention may vary, depending upon identity, size, and/or condition of subjects to be treated and further depending upon routes by which compositions are to be administered. By way of example, compositions may comprise between about 0.1% and 100%, e.g., from about 0.5% to about 50%, from about 1% to about 30%, from about 5% to about 80% or at least 80% (w/w) active ingredient. In some embodiments, active ingredients are antibodies directed toward regulatory elements and/or GPCs.

Formulations

Compounds and/or compositions of the present invention may be formulated using one or more excipients to: (1) increase stability; (2) increase cell permeability; (3) permit the sustained or delayed release (e.g., of compounds and/or growth factors from such formulations); and/or (4) alter the biodistribution (e.g., target compounds to specific tissues or cell types). In addition to traditional excipients such as any and all solvents, dispersion media, diluents, liquid vehicles, dispersion aids, suspension aids, surface active agents, isotonic agents, thickening agents, emulsifying agents and preservatives, formulations of the present invention may comprise, without limitation, liposomes, lipid nanoparticles, polymers, lipoplexes, core-shell nanoparticles, peptides, proteins, cells transfected with the compounds and/or compositions of the present invention (e.g., for transplantation into subjects) and combinations thereof.

Excipients

Various excipients for formulating pharmaceutical compositions and techniques for preparing the composition are known in the art (see Remington: The Science and Practice of Pharmacy, $21^{st}$ Edition, A. R. Gennaro, Lippincott, Williams & Wilkins, Baltimore, Md., 2006; incorporated herein by reference).

In some embodiments, the use of conventional excipient media are contemplated within the scope of the present disclosure, except insofar as any conventional excipient media may be incompatible with substances and/or their derivatives, such as by producing any undesirable biological effects or otherwise interacting in deleterious manners with any other component(s) of pharmaceutical compositions.

Formulations of pharmaceutical compositions described herein may be prepared by any method known or hereafter developed in the art of pharmacology. In general, such preparatory methods include steps of associating active ingredients with excipients and/or other accessory ingredients.

Pharmaceutical compositions, in accordance with the present disclosure, may be prepared, packaged, and/or sold in bulk, as single unit doses, and/or as a plurality of single unit doses.

Relative amounts of active ingredients, pharmaceutically acceptable excipients, and/or additional ingredients in pharmaceutical compositions of the present disclosure may vary, depending upon identity, size, and/or condition of subjects being treated and further depending upon routes by which pharmaceutical compositions may be administered.

In some embodiments, pharmaceutically acceptable excipient are at least 95%, at least 96%, at least 97%, at least 98%, at least 99% or 100% pure. In some embodiments, excipients are approved for use in humans and/or for veterinary use. In some embodiments, excipients are approved by the United States Food and Drug Administration. In some embodiments, excipients are pharmaceutical grade. In some embodiments, excipients meet the standards of the United States Pharmacopoeia (USP), the European Pharmacopoeia (EP), the British Pharmacopoeia, and/or the International Pharmacopoeia.

In some embodiments, pharmaceutically acceptable excipients of the present invention may include, but are not limited to, inert diluents, dispersing and/or granulating agents, surface active agents and/or emulsifiers, disintegrating agents, binding agents, preservatives, buffering agents, lubricating agents, and/or oils. Such excipients may optionally be included in pharmaceutical compositions.

Exemplary diluents include, but are not limited to, calcium carbonate, sodium carbonate, calcium phosphate, dicalcium phosphate, calcium sulfate, calcium hydrogen phosphate, sodium phosphate lactose, sucrose, cellulose, microcrystalline cellulose, kaolin, mannitol, sorbitol, inositol, sodium chloride, dry starch, cornstarch, powdered sugar, etc., and/or combinations thereof.

Exemplary granulating and/or dispersing agents include, but are not limited to, potato starch, corn starch, tapioca starch, sodium starch glycolate, clays, alginic acid, guar gum, citrus pulp, agar, bentonite, cellulose and wood products, natural sponge, cation-exchange resins, calcium carbonate, silicates, sodium carbonate, cross-linked poly(vinyl-pyrrolidone) (crospovidone), sodium carboxymethyl starch (sodium starch glycolate), carboxymethyl cellulose, cross-linked sodium carboxymethyl cellulose (croscarmellose), methylcellulose, pregelatinized starch (starch 1500), microcrystalline starch, water insoluble starch, calcium carboxymethyl cellulose, magnesium aluminum silicate (VEEGUM®), sodium lauryl sulfate, quaternary ammonium compounds, etc., and/or combinations thereof.

Exemplary surface active agents and/or emulsifiers include, but are not limited to, natural emulsifiers (e.g. acacia, agar, alginic acid, sodium alginate, tragacanth, chondrux, cholesterol, xanthan, pectin, gelatin, egg yolk, casein, wool fat, cholesterol, wax, and lecithin), colloidal clays (e.g. bentonite [aluminum silicate] and VEEGUM® [magnesium aluminum silicate]), long chain amino acid derivatives, high molecular weight alcohols (e.g. stearyl alcohol, cetyl alcohol, oleyl alcohol, triacetin monostearate, ethylene glycol distearate, glyceryl monostearate, and propylene glycol monostearate, polyvinyl alcohol), carbomers (e.g. carboxy polymethylene, polyacrylic acid, acrylic acid polymer, and carboxyvinyl polymer), carrageenan, cellulosic derivatives (e.g. carboxymethylcellulose sodium, powdered cellulose, hydroxymethyl cellulose, hydroxypropyl cellulose, hydroxypropyl methylcellulose, methylcellulose), sorbitan fatty acid esters (e.g. polyoxyethylene sorbitan monolaurate [TWEEN®20], polyoxyethylene sorbitan [TWEENn®60], polyoxyethylene sorbitan monooleate [TWEEN®80], sorbitan monopalmitate [SPAN®40], sorbitan monostearate [Span®60], sorbitan tristearate [Span®65], glyceryl monooleate, sorbitan monooleate [SPAN®80]), polyoxyethylene esters (e.g. polyoxyethylene monostearate [MYRJ®45], polyoxyethylene hydrogenated castor oil, polyethoxylated castor oil, polyoxymethylene stearate, and SOLUTOL®), sucrose fatty acid esters, polyethylene glycol fatty acid esters (e.g. CREMOPHOR®), polyoxyethylene ethers, (e.g. polyoxyethylene lauryl ether [BRIJ®30], poly(vinyl-pyrrolidone), diethylene glycol monolaurate, triethanolamine oleate, sodium oleate, potassium oleate, ethyl oleate, oleic acid, ethyl laurate, sodium lauryl sulfate, PLUORINC®F 68, POLOXAMER 188, cetrimonium bromide, cetylpyridinium chloride, benzalkonium chloride, docusate sodium, etc. and/or combinations thereof.

Exemplary binding agents include, but are not limited to, starch (e.g. cornstarch and starch paste); gelatin; sugars (e.g. sucrose, glucose, dextrose, dextrin, molasses, lactose, lactitol, mannitol,); natural and synthetic gums (e.g. acacia, sodium alginate, extract of Irish moss, panwar gum, ghatti gum, mucilage of isapol husks, carboxymethylcellulose, methylcellulose, ethylcellulose, hydroxyethylcellulose, hydroxypropyl cellulose, hydroxypropyl methylcellulose, microcrystalline cellulose, cellulose acetate, poly(vinyl-pyrrolidone), magnesium aluminum silicate (Veegum®), and larch arabogalactan); alginates; polyethylene oxide; polyethylene glycol; inorganic calcium salts; silicic acid; polymethacrylates; waxes; water; alcohol; etc.; and combinations thereof.

Exemplary preservatives may include, but are not limited to, antioxidants, chelating agents, antimicrobial preservatives, antifungal preservatives, alcohol preservatives, acidic preservatives, and/or other preservatives. Exemplary antioxidants include, but are not limited to, alpha tocopherol, ascorbic acid, acorbyl palmitate, butylated hydroxyanisole, butylated hydroxytoluene, monothioglycerol, potassium metabisulfite, propionic acid, propyl gallate, sodium ascorbate, sodium bisulfite, sodium metabisulfite, and/or sodium sulfite. Exemplary chelating agents include ethylenediaminetetraacetic acid (EDTA), citric acid monohydrate, disodium edetate, dipotassium edetate, edetic acid, fumaric acid, malic acid, phosphoric acid, sodium edetate, tartaric acid, and/or trisodium edetate. Exemplary antimicrobial preservatives include, but are not limited to, benzalkonium chloride, benzethonium chloride, benzyl alcohol, bronopol, cetrimide, cetylpyridinium chloride, chlorhexidine, chlorobutanol, chlorocresol, chloroxylenol, cresol, ethyl alcohol, glycerin, hexetidine, imidurea, phenol, phenoxyethanol, phenylethyl alcohol, phenylmercuric nitrate, propylene glycol, and/or thimerosal. Exemplary antifungal preservatives include, but are not limited to, butyl paraben, methyl paraben, ethyl paraben, propyl paraben, benzoic acid, hydroxybenzoic acid, potassium benzoate, potassium sorbate, sodium benzoate, sodium propionate, and/or sorbic acid. Exemplary alcohol preservatives include, but are not limited to, ethanol, polyethylene glycol, phenol, phenolic compounds, bisphenol, chlorobutanol, hydroxybenzoate, and/or phenylethyl alcohol. Exemplary acidic preservatives include, but are not limited to, vitamin A, vitamin C, vitamin E, beta-carotene, citric acid, acetic acid, dehydroacetic acid, ascorbic acid, sorbic acid, and/or phytic acid. Other preservatives include, but are not limited to, tocopherol, tocopherol acetate, deteroxime mesylate, cetrimide, butylated hydroxyanisol (BHA), butylated hydroxytoluened (BHT), ethylenediamine, sodium lauryl sulfate (SLS), sodium lauryl ether sulfate (SLES), sodium bisulfite, sodium metabisulfite, potassium sulfite, potassium metabisulfite, GLYDANT PLUS®, PHENONIP®, methylparaben, GERMALL®115, GERMABEN®II, NEOLONE™, KATHON™, and/or EUXYL®.

Exemplary buffering agents include, but are not limited to, citrate buffer solutions, acetate buffer solutions, phosphate buffer solutions, ammonium chloride, calcium carbonate, calcium chloride, calcium citrate, calcium glubionate, calcium gluceptate, calcium gluconate, D-gluconic acid, calcium glycerophosphate, calcium lactate, propanoic acid, calcium levulinate, pentanoic acid, dibasic calcium phosphate, phosphoric acid, tribasic calcium phosphate, calcium hydroxide phosphate, potassium acetate, potassium chloride, potassium gluconate, potassium mixtures, dibasic potassium phosphate, monobasic potassium phosphate, potassium phosphate mixtures, sodium acetate, sodium bicarbonate, sodium chloride, sodium citrate, sodium lactate, dibasic sodium phosphate, monobasic sodium phosphate, sodium phosphate mixtures, tromethamine, magnesium hydroxide, aluminum hydroxide, alginic acid, pyrogen-free water, isotonic saline, Ringer's solution, ethyl alcohol, etc., and/or combinations thereof.

Exemplary lubricating agents include, but are not limited to, magnesium stearate, calcium stearate, stearic acid, silica, talc, malt, glyceryl behanate, hydrogenated vegetable oils, polyethylene glycol, sodium benzoate, sodium acetate, sodium chloride, leucine, magnesium lauryl sulfate, sodium lauryl sulfate, etc., and combinations thereof.

Exemplary oils include, but are not limited to, almond, apricot kernel, avocado, babassu, bergamot, black current seed, borage, cade, camomile, canola, caraway, carnauba, castor, cinnamon, cocoa butter, coconut, cod liver, coffee, corn, cotton seed, emu, eucalyptus, evening primrose, fish, flaxseed, geraniol, gourd, grape seed, hazel nut, hyssop, isopropyl myristate, jojoba, kukui nut, lavandin, lavender, lemon, litsea cubeba, macademia nut, mallow, mango seed, meadowfoam seed, mink, nutmeg, olive, orange, orange roughy, palm, palm kernel, peach kernel, peanut, poppy seed, pumpkin seed, rapeseed, rice bran, rosemary, safflower, sandalwood, sasquana, savoury, sea buckthorn, sesame, shea butter, silicone, soybean, sunflower, tea tree, thistle, tsubaki, vetiver, walnut, and wheat germ oils. Exemplary oils include, but are not limited to, butyl stearate, caprylic triglyceride, capric triglyceride, cyclomethicone, diethyl sebacate, dimethicone 360, isopropyl myristate, mineral oil, octyldodecanol, oleyl alcohol, silicone oil, and/or combinations thereof.

Excipients such as cocoa butter and suppository waxes, coloring agents, coating agents, sweetening, flavoring, and/or perfuming agents can be present in the composition, according to the judgment of the formulator.

Formulation Vehicles: Liposomes, Lipoplexes, and Lipid Nanoparticles

Compounds and/or compositions of the present invention may be formulated using one or more liposomes, lipoplexes and/or lipid nanoparticles. In some embodiments, pharmaceutical compositions comprise liposomes. Liposomes are artificially-prepared vesicles which may primarily be composed of a lipid bilayer and may be used as delivery vehicles for the administration of nutrients and pharmaceutical formulations. Liposomes may be of different sizes such as, but not limited to, multilamellar vesicles (MLVs) which may be hundreds of nanometers in diameter and may contain a series of concentric bilayers separated by narrow aqueous compartments, small unicellular vesicle (SUVs) which may be smaller than 50 nm in diameter and large unilamellar vesicle (LUVs) which may be between 50 and 500 nm in diameter. Liposome components may include, but are not limited to, opsonins or ligands in order to improve the attachment of liposomes to unhealthy tissue or to activate events such as, but not limited to, endocytosis. Liposomes may comprise low or high pH. In some embodiments, liposome pH may be varied in order to improve delivery of pharmaceutical formulations.

In some embodiments, liposome formation may depend on physicochemical characteristics such as, but not limited to, the pharmaceutical formulation entrapped, liposomal ingredients, the nature of the medium in which lipid vesicles are dispersed, the effective concentration of entrapped substances, potential toxicity of entrapped substances, additional processes involved during the application and/or delivery of vesicles, optimization size, polydispersity, shelf-life of vesicles for the intended application, batch-to-batch reproducibility and possibility of large-scale production of safe and efficient liposomal products.

In some embodiments, formulations may be assembled or compositions altered such that they are passively or actively directed to different cell types in vivo.

In some embodiments, formulations may be selectively targeted through expression of different ligands on formulation surfaces as exemplified by, but not limited by, folate, transferrin, N-acetylgalactosamine (GalNAc), and antibody targeted approaches.

In some embodiments, pharmaceutical compositions of the present invention may be formulated with liposomes, lipoplexes and/or lipid nanoparticles to improve efficacy of function. Such formulations may be able to increase cell transfection by pharmaceutical compositions. In some embodiments, liposomes, lipoplexes, or lipid nanoparticles may be used to increase pharmaceutical composition stability.

In some embodiments, liposomes are specifically formulated for pharmaceutical compositions comprising one or more antibodies. Such liposomes may be prepared according to techniques known in the art, such as those described by Eppstein et al. (Eppstein, D. A. et al., Biological activity of liposome-encapsulated murine interferon gamma is mediated by a cell membrane receptor. Proc Natl Acad Sci USA. 1985 June; 82(11):3688-92); Hwang et al. (Hwang, K. J. et al., Hepatic uptake and degradation of unilamellar sphingomyelin/cholesterol liposomes: a kinetic study. Proc Natl Acad Sci USA. 1980 July; 77(7):4030-4); U.S. Pat. No. 4,485,045 and U.S. Pat. No. 4,544,545. Production of liposomes with sustained circulation time are also described in U.S. Pat. No. 5,013,556.

In some embodiments, liposomes of the present invention comprising antibodies may be generated using reverse phase evaporation utilizing lipids such as phosphatidylcholine, cholesterol as well as phosphatidylethanolamine that have been polyethylene glycol-derivatized. Filters with defined pore size are used to extrude liposomes of the desired diameter. In another embodiment, compounds and/or compositions of the present invention may be conjugated to external surfaces of liposomes by disulfide interchange reactions as is described by Martin et al. (Martin, F. J. et al., Irreversible coupling of immunoglobulin fragments to preformed vesicles. An improved method for liposome targeting. J Biol Chem. 1982 Jan. 10; 257(1):286-8).

Formulation Vehicles: Polymers and Nanoparticles

Compounds and/or compositions of the present invention may be formulated using natural and/or synthetic polymers. Non-limiting examples of polymers which may be used for delivery include, but are not limited to DMRI/DOPE, poloxamer, chitosan, cyclodextrin, and poly(lactic-co-glycolic acid) (PLGA) polymers. In some embodiments, polymers may be biodegradable.

In some embodiments, polymer formulation may permit sustained and/or delayed release of compounds and/or compositions (e.g., following intramuscular and/or subcutaneous injection). Altered release profile for compounds and/or compositions of the present invention may result in, for example, compound release over an extended period of time. Polymer formulations may also be used to increase the stability of compounds and/or compositions of the present invention.

In some embodiments, polymer formulations may be selectively targeted through expression of different ligands as exemplified by, but not limited by, folate, transferrin, and N-acetylgalactosamine (GalNAc) (Benoit, D. S. et al., Synthesis of folate-functionalized RAFT polymers for targeted siRNA delivery. Biomacromolecules. 2011 12:2708-14; Rozema, D. B. et al., Dynamic polyconjugates for targeted in vivo delivery of siRNA to hepatocytes. Proc Natl Acad Sci USA. 2007 104:12982-12887; Davis, M. E. et al., The first targeted delivery of siRNA in humans via a self-assembling, cyclodextrin polymer-based nanoparticle: from concept to clinic. Mol Pharm. 2009 6:659-668; Davis, M. E. et al., Evidence of RNAi in humans from systemically administered siRNA via targeted nanoparticles. Nature. 2010. 464:1067-70; the contents of each of which are herein incorporated by reference in their entirety.)

Compounds and/or compositions of the present invention may be formulated as nanoparticles using combinations of polymers, lipids, and/or other biodegradable agents, such as, but not limited to, calcium phosphates. In some embodiments, components may be combined in core-shells, hybrids, and/or layer-by-layer architectures, to allow for fine-tuning of nanoparticle structure, so delivery may be enhanced. For antibodies of the present invention, systems based on poly(2-(methacryloyloxy)ethyl phosphorylcholine)-block-(2-(diisopropylamino)ethyl methacrylate), (PMPC-PDPA), a pH sensitive diblock copolymer that self-assembles to form nanometer-sized vesicles, also known as polymersomes, at physiological pH may be used. These polymersomes have been shown to successfully deliver relatively high antibody payloads within live cells. (Massignani, M. et al., Cellular delivery of antibodies: effective targeted subcellular imaging and new therapeutic tool. Nature Proceedings. 2010. p 1-17.)

In some embodiments, PEG-charge-conversional polymers (Pitella, F. et al., *Enhanced endosomal escape of siRNA-* incorporating hybrid nanoparticles from calcium phosphate and PEG-block charge-conversional polymer for efficient gene knockdown with negligible cytotoxicity. Biomaterials. 2011 32:3106-14) may be used to form nanoparticles for delivery of compounds and/or compositions of the present invention. In some embodiments, PEG-charge-conversional polymers may improve upon PEG-polyanion block copolymers by being cleaved into polycations at acidic pH, thus enhancing endosomal escape.

In some embodiments, complexation, delivery and/or internalization of polymeric nanoparticles may be precisely controlled by altering chemical compositions in both core and shell nanoparticle components (Siegwart, D. J. et al., Combinatorial synthesis of chemically diverse core-shell nanoparticles for intracellular delivery. Proc Natl Acad Sci USA. 2011 108:12996-3001).

In some embodiments, matrices of poly(ethylene-co-vinyl acetate), are used to deliver compounds and/or compositions of the invention. Such matrices have bee described by others (Sherwood, J. K. et al., Controlled antibody delivery systems. Nature Biotechnology. 1992. 10:1446-9.)

Antibody Formulations

Antibodies of the present invention may be formulated for intravenous administration or extravascular administration (Daugherty, et al., Formulation and delivery issues for monoclonal antibody therapeutics. Adv Drug Deliv Rev. 2006 Aug. 7; 58(5-6):686-706 and US patent application publication number US2011/0135570, the contents of each of which are herein incorporated by reference in their entirety). Extravascular administration routes may include, but are not limited to subcutaneous administration, intraperitoneal administration, intracerebral administration, intraocular administration, intralesional administration, topical administration and intramuscular administration.

In some embodiments, antibody structures may be modified to improve effectiveness as therapeutics. Improvements may include, but are not limited to improved thermodynamic stability, reduced Fc receptor binding properties and/or improved folding efficiency. Modifications may include, but are not limited to amino acid substitutions, glycosylation, palmitoylation and/or protein conjugation.

In some embodiments, antibodies of the present invention may be formulated with antioxidants to reduce antibody oxidation. Antibodies of the present invention may also be formulated with additives to reduce protein aggregation. Such additives may include, but are not limited to albumin, amino acids, sugars, urea, guanidinium chloride, polyalchohols, polymers (such as polyethylene glycol and dextrans), surfactants (including, but not limited to polysorbate 20 and polysorbate 80) or even other antibodies.

In some embodiments, antibodies of the present invention may be formulated to reduce the impact of water on antibody structure and function. Antibody preparations in such formulations may be may be lyophilized. Formulations subject to lyophilization may include carbohydrates or polyol compounds to protect and/or stabilize antibody structure. Such compounds may include, but are not limited to sucrose, trehalose and mannitol.

In some embodiments, antibodies of the present invention may be formulated with polymers. In some embodiments, polymer formulations may comprise hydrophobic polymers. Such polymers may be microspheres formulated with poly-lactide-co-glycolide through solid-in-oil-in-water encapsulation methods. In some embodiments, microspheres comprising ethylene-vinyl acetate copolymer may also be used for antibody delivery and/or to extend the time course of antibody release at sites of delivery. In some embodiments, polymers may be aqueous gels. Such gels may, for example, comprise carboxymethylcellulose. In some embodiments, aqueous gels may also comprise hyaluronic acid hydrogels. In some embodiments, antibodies may be covalently linked to such gels through hydrazone linkages that allow for sustained delivery in tissues, including but not limited to tissues of the central nervous system.

Formulation Vehicles: Peptides and Proteins

Compounds and/or compositions of the present invention may be formulated with peptides and/or proteins. In some embodiments, peptides such as, but not limited to, cell penetrating peptides and/or proteins/peptides that enable intracellular delivery may be used to deliver pharmaceutical formulations. Non-limiting examples of a cell penetrating peptides which may be used with pharmaceutical formulations of the present invention include cell-penetrating peptide sequences attached to polycations that facilitates delivery to the intracellular space, e.g., HIV-derived TAT peptide, penetratins, transportans, or hCT derived cell-penetrating peptides (see, e.g. Caron, N. J. et al., Intracellular delivery of a Tat-eGFP fusion protein into muscle cells. Mol Ther. 2001. 3(3):310-8; Langel, U., Cell-Penetrating Peptides: Processes and Applications, CRC Press, Boca Raton Fla., 2002; El-Andaloussi, S. et al., Cell-penetrating peptides: mechanisms and applications. Curr Pharm Des. 2003. 11(28):3597-611; and Deshayes, S. et al., Cell-penetrating peptides: tools for intracellular delivery of therapeutics. Cell Mol Life Sci. 2005. 62(16):1839-49, the contents of each of which are herein incorporated by reference in their entirety.) Compounds and/or compositions of the present invention may also be formulated to include cell penetrating agents, e.g., liposomes, which enhance delivery of the compositions to intracellular spaces. Compounds and/or compositions of the present invention may be complexed with peptides and/or proteins such as, but not limited to, peptides and/or proteins from Aileron Therapeutics (Cambridge, Mass.) and Permeon Biologics (Cambridge, Mass.) in order to enable intracellular delivery (Cronican, J. J. et al., Potent delivery of functional proteins into mammalian cells in vitro and in vivo using a supercharged protein. ACS Chem Biol. 2010. 5:747-52; McNaughton, B. R. et al., Mammalian cell penetration, siRNA transfection, and DNA transfection by supercharged proteins. Proc Natl Acad Sci, USA. 2009. 106:6111-6; Verdine, G. L. et al., Stapled peptides for intracellular drug targets. Methods Enzymol. 2012. 503:3-33; the contents of each of which are herein incorporated by reference in their entirety).

In some embodiments, the cell-penetrating polypeptides may comprise first and second domains. First domains may comprise supercharged polypeptides. Second domains may comprise protein-binding partner. As used herein, protein-binding partners may include, but are not limited to, antibodies and functional fragments thereof, scaffold proteins and/or peptides. Cell-penetrating polypeptides may further comprise intracellular binding partners for protein-binding partners. In some embodiments, cell-penetrating polypeptides may be capable of being secreted from cells where compounds and/or compositions of the present invention may be introduced.

Compositions of the present invention comprising peptides and/or proteins may be used to increase cell transfection and/or alter compound/composition biodistribution (e.g., by targeting specific tissues or cell types).

Formulation Vehicles: Cells

Cell-based formulations of compounds and/or compositions of the present invention may be used to ensure cell transfection (e.g., in cellular carriers) or to alter biodistribution (e.g., by targeting cell carriers to specific tissues or cell types.)

Cell Transfer Methods

A variety of methods are known in the art and suitable for introduction of nucleic acids or proteins into cells, including viral and non-viral mediated techniques. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

The technique of sonoporation, or cellular sonication, is the use of sound (e.g., ultrasonic frequencies) for modifying the permeability of cell plasma membranes. Sonoporation methods are known to those in the art and are used to deliver nucleic acids in vivo (Yoon, C. S. et al., Ultrasound-mediated gene delivery. Expert Opin Drug Deliv. 2010 7:321-30; Postema, M. et al., Ultrasound-directed drug delivery. Curr Pharm Biotechnol. 2007 8:355-61; Newman, C. M. et al., Gene therapy progress and prospects: ultrasound for gene transfer. Gene Ther. 2007. 14(6):465-75; the contents of each of which are herein incorporated by reference in their entirety). Sonoporation methods are known in the art and are also taught for example as they relate to bacteria in US Patent application publication US2010/0196983 and as it relates to other cell types in, for example, US Patent application publication US2010/0009424, the contents of each of which are incorporated herein by reference in their entirety.

Electroporation techniques are also well known in the art and are used to deliver nucleic acids in vivo and clinically (Andre, F. M. et al., Nucleic acids electrotransfer in vivo: mechanisms and practical aspects. Curr Gene Ther. 2010 10:267-80; Chiarella, P. et al., Application of electroporation in DNA vaccination protocols. Curr Gene Ther. 2010. 10:281-6; Hojman, P., Basic principles and clinical advancements of muscle electrotransfer. Curr Gene Ther. 2010 10:128-38; the contents of each of which are herein incorporated by reference in their entirety). In some embodiments, compounds and/or compositions of the present invention may be delivered by electroporation.

Administration and Delivery

Compounds and/or compositions of the present invention may be administered by any of the standard methods or routes known in the art. Such methods may include any route which results in a therapeutically effective outcome. These include, but are not limited to, enteral, gastroenteral, epidural, oral, transdermal, epidural (peridural), intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection, (into the base of the penis), intravaginal administration, intrauterine, extra-amniotic administration, transdermal (diffusion through the intact skin for systemic distribution), transmucosal (diffusion through a mucous membrane), insufflation (snorting), sublingual, sublabial, enema, eye drops (onto the conjunctiva), or in ear drops. In specific embodiments, compounds and/or compositions of the present invention may be administered in ways which allow them to cross the blood-brain barrier, vascular barriers, or other epithelial barriers. Methods of formulation and administration may include any of those disclosed in US Pub. No. 2013/0122007, U.S. Pat. No. 8,415,459 or International Pub. No. WO 2011/151432, the contents of each of which are herein incorporated by reference in their entirety. Non-limiting routes of administration for compounds and/or compositions of the present invention are described below.

Parenteral and Injectable Administration

In some embodiments, compounds and/or compositions of the present invention may be administered parenterally. Liquid dosage forms for oral and parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof. In other embodiments, surfactants are included such as hydroxypropylcellulose.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose any bland fixed oil can be employed including synthetic mono- or diglycerides. Fatty acids such as oleic acid can be used in the preparation of injectables.

Injectable formulations may be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of active ingredients, it is often desirable to slow the absorption of active ingredients from subcutaneous or intramuscular injections. This may be accomplished by the use of liquid suspensions of crystalline or amorphous material with poor water solubility. The rate of absorption of active ingredients depends upon the rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are prepared by entrapping the drug in liposomes or microemulsions which are compatible with body tissues.

Rectal and Vaginal Administration

In some embodiments, compounds and/or compositions of the present invention may be administered rectally and/or vaginally. Compositions for rectal or vaginal administration are typically suppositories which can be prepared by mixing compositions with suitable non-irritating excipients such as cocoa butter, polyethylene glycol or a suppository wax which are solid at ambient temperature but liquid at body temperature and therefore melt in the rectum or vaginal cavity and release the active ingredient.

Oral Administration

In some embodiments, compounds and/or compositions of the present invention may be administered orally. Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and acacia), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents.

Topical or Transdermal Administration

As described herein, compounds and/or compositions of the present invention may be formulated for administration topically. The skin may be an ideal target site for delivery as it is readily accessible. Three routes are commonly considered to deliver compounds and/or compositions of the present invention to the skin: (i) topical application (e.g. for local/regional treatment and/or cosmetic applications); (ii) intradermal injection (e.g. for local/regional treatment and/or cosmetic applications); and (iii) systemic delivery (e.g. for treatment of dermatologic diseases that affect both cutaneous and extracutaneous regions). Compounds and/or compositions of the present invention can be delivered to the skin by several different approaches known in the art.

In some embodiments, the invention provides for a variety of dressings (e.g., wound dressings) or bandages (e.g., adhesive bandages) for conveniently and/or effectively carrying out methods of the present invention. Typically dressing or bandages may comprise sufficient amounts of compounds and/or compositions of the present invention described herein to allow users to perform multiple treatments.

Dosage forms for topical and/or transdermal administration may include ointments, pastes, creams, lotions, gels, powders, solutions, sprays, inhalants and/or patches. Generally, active ingredients are admixed under sterile conditions with pharmaceutically acceptable excipients and/or any needed preservatives and/or buffers. Additionally, the present invention contemplates the use of transdermal patches, which often have the added advantage of providing controlled delivery of compounds and/or compositions of the present invention to the body. Such dosage forms may be prepared, for example, by dissolving and/or dispensing compounds and/or compositions in the proper medium. Alternatively or additionally, rates may be controlled by either providing rate controlling membranes and/or by dispersing compounds and/or compositions in a polymer matrix and/or gel.

Formulations suitable for topical administration include, but are not limited to, liquid and/or semi liquid preparations such as liniments, lotions, oil in water and/or water in oil emulsions such as creams, ointments and/or pastes, and/or solutions and/or suspensions.

Topically-administrable formulations may, for example, comprise from about 1% to about 10% (w/w) active ingredient, although the concentration of active ingredient may be as high as the solubility limit of the active ingredient in the solvent. Formulations for topical administration may further comprise one or more of the additional ingredients described herein.

Depot Administration

As described herein, in some embodiments, compounds and/or compositions of the present invention are formulated in depots for extended release. Generally, specific organs or tissues ("target tissues") are targeted for administration.

In some aspects of the invention, compounds and/or compositions of the present invention are spatially retained within or proximal to target tissues. Provided are method of providing compounds and/or compositions to target tissues of mammalian subjects by contacting target tissues (which comprise one or more target cells) with compounds and/or compositions under conditions such that they are substantially retained in target tissues, meaning that at least 10, 20, 30, 40, 50, 60, 70, 80, 85, 90, 95, 96, 97, 98, 99, 99.9, 99.99 or greater than 99.99% of the composition is retained in the target tissues. Advantageously, retention is determined by measuring the amount of compounds and/or compositions that enter one or more target cells. For example, at least 1%, 5%, 10%, 20%, 30%, 40%, 50%, 60%, 70%, 80%, 85%, 90%, 95%, 96%, 97%, 98%, 99%, 99.9%, 99.99% or greater than 99.99% of compounds and/or compositions administered to subjects are present intracellularly at a period of time following administration. For example, intramuscular injection to mammalian subjects may be performed using aqueous compositions comprising compounds and/or compositions of the present invention and one or more transfection reagent, and retention is determined by measuring the amount of compounds and/or compositions present in muscle cells.

Certain aspects of the invention are directed to methods of providing compounds and/or compositions of the present invention to a target tissues of mammalian subjects, by contacting target tissues (comprising one or more target cells) with compounds and/or compositions under conditions such that they are substantially retained in such target tissues. Compounds and/or compositions comprise enough active ingredient such that the effect of interest is produced in at least one target cell. In some embodiments, compounds and/or compositions generally comprise one or more cell penetration agents, although "naked" formulations (such as without cell penetration agents or other agents) are also contemplated, with or without pharmaceutically acceptable carriers.

In some embodiments, the amount of a growth factor present in cells in a tissue is desirably increased. Preferably, this increase in growth factor is spatially restricted to cells within the target tissue. Thus, provided are methods of increasing the amount of growth factor of interest in tissues of mammalian subjects. In some embodiments, formulations are provided comprising compounds and/or compositions characterized in that the unit quantity provided has been determined to produce a desired level of growth factor of interest in a substantial percentage of cells contained within predetermined volumes of target tissue.

In some embodiments, formulations comprise a plurality of different compounds and/or compositions, where one or more than one targets biomolecules of interest. Optionally, formulations may also comprise cell penetration agents to assist in the intracellular delivery of compounds and/or compositions. In such embodiments, determinations are made of compound and/or composition dose required to target biomolecules of interest in substantial percentages of cells contained within predetermined volumes of the target tissue (generally, without targeting biomolecules of interest in adjacent or distal tissues.) Determined doses are then introduced directly into subject tissues. In some embodiments, the invention provides for compounds and/or compositions to be delivered in more than one administration or by split dose administration.

Pulmonary Administration

In some embodiments, compounds and/or compositions of the present invention may be prepared, packaged, and/or sold in formulations suitable for pulmonary administration. In some embodiments, such administration is via the buccal cavity. In some embodiments, formulations may comprise dry particles comprising active ingredients. In such embodiments, dry particles may have a diameter in the range from about 0.5 nm to about 7 nm or from about 1 nm to about 6 nm. In some embodiments, formulations may be in the form of dry powders for administration using devices comprising dry powder reservoirs to which streams of propellant may be directed to disperse such powder. In some embodiments, self propelling solvent/powder dispensing containers may be used. In such embodiments, active ingredients may be dissolved and/or suspended in low-boiling propellant in sealed containers. Such powders may comprise particles wherein at least 98% of the particles by weight have diameters greater than 0.5 nm and at least 95% of the particles by number have diameters less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form.

Low boiling propellants generally include liquid propellants having a boiling point of below 65° F. at atmospheric pressure. Generally propellants may constitute 50% to 99.9% (w/w) of the composition, and active ingredient may constitute 0.1% to 20% (w/w) of the composition. Propellants may further comprise additional ingredients such as liquid non-ionic and/or solid anionic surfactant and/or solid diluent (which may have particle sizes of the same order as particles comprising active ingredients).

Pharmaceutical compositions formulated for pulmonary delivery may provide active ingredients in the form of droplets of solution and/or suspension. Such formulations may be prepared, packaged, and/or sold as aqueous and/or dilute alcoholic solutions and/or suspensions, optionally sterile, comprising active ingredients, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. Droplets provided by this route of administration may have an average diameter in the range from about 0.1 nm to about 200 nm.

Intranasal, Nasal and Buccal Administration

In some embodiments, compounds and/or compositions of the present invention may be administered nasaly and/or intranasaly. In some embodiments, formulations described herein as being useful for pulmonary delivery may also be useful for intranasal delivery. In some embodiments, formulations for intranasal administration comprise a coarse powder comprising the active ingredient and having an average particle from about 0.2 μm to 500 μm. Such formulations are administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, 0.1% to 20% (w/w) active ingredient, the balance comprising an orally dissolvable and/or degradable composition and, optionally, one or more of the additional ingredients described herein. Alternately, formulations suitable for buccal administration may comprise powders and/or an aerosolized and/or atomized solutions and/or suspensions comprising active ingredients. Such powdered, aerosolized, and/or aerosolized formulations, when dispersed, may comprise average particle and/or droplet sizes in the range of from about 0.1 nm to about 200 nm, and may further comprise one or more of any additional ingredients described herein.

Ophthalmic or Otic Administration

In some embodiments, compounds and/or compositions of the present invention may be prepared, packaged, and/or sold in formulations suitable for ophthalmic and/or otic administration. Such formulations may, for example, be in the form of eye and/or ear drops including, for example, a 0.1/1.0% (w/w) solution and/or suspension of the active ingredient in aqueous and/or oily liquid excipients. Such drops may further comprise buffering agents, salts, and/or one or more other of any additional ingredients described herein. Other ophthalmically-administrable formulations which are useful include those which comprise active ingredients in microcrystalline form and/or in liposomal preparations. Subretinal inserts may also be used as forms of administration.

Payload Administration: Detectable Agents and Therapeutic Agents

In some embodiments, compounds and/or compositions of the present invention may be used in a number of different scenarios in which delivery of a substance (the "payload") to a biological target is desired, for example delivery of detectable substances for detection of the target, or delivery of therapeutic and/or diagnostic agents. Detection methods may include, but are not limited to, both in vitro and in vivo imaging methods, e.g., immunohistochemistry, bioluminescence imaging (BLI), Magnetic Resonance Imaging (MRI), positron emission tomography (PET), electron microscopy, X-ray computed tomography, Raman imaging, optical coherence tomography, absorption imaging, thermal imaging, fluorescence reflectance imaging, fluorescence microscopy, fluorescence molecular tomographic imaging, nuclear magnetic resonance imaging, X-ray imaging, ultrasound imaging, photoacoustic imaging, lab assays, or in any situation where tagging/staining/imaging is required.

In some embodiments, compounds and/or compositions may be designed to include both linkers and payloads in any useful orientation. For example, linkers having two ends may be used to attach one end to the payload and the other end to compounds and/or compositions. Compounds and/or compositions of the present invention may include more than one payload. In some embodiments, compounds and/or compositions may comprise one or more cleavable linker. In some embodiments, payloads may be attached to compounds and/or compositions via a linker and may be fluorescently labeled for in vivo tracking, e.g. intracellularly.

In some embodiments, compounds and/or compositions of the present invention may be used in reversible drug delivery into cells.

Compounds and/or compositions of the present invention may be used in intracellular targeting of payloads, e.g., detectable or therapeutic agents, to specific organelles. In addition, compounds and/or compositions of the present invention may be used to deliver therapeutic agents to cells or tissues, e.g., in living animals. For example, the compounds and/or compositions described herein may be used to deliver chemotherapeutic agents to kill cancer cells. Compounds and/or compositions may be attached to therapeutic agents through one or more linkers may facilitate membrane permeation allowing therapeutic agents to travel into cells to reach intracellular targets.

In some embodiments, payloads may be a therapeutic agent such as a cytotoxins, radioactive ions, chemotherapeutics, or other therapeutic agents. Cytotoxins and/or cytotoxic agents may include any agents that may be detrimental to cells. Examples include, but are not limited to, taxol, cytochalasin B, gramicidin D, ethidium bromide, emetine, mitomycin, etoposide, teniposide, vincristine, vinblastine, colchicine, doxorubicin, daunorubicin, dihydroxyanthracinedione, mitoxantrone, mithramycin, actinomycin D, 1-dehydrotestosterone, glucocorticoids, procaine, tetracaine, lidocaine, propranolol, puromycin, maytansinoids, e.g., maytansinol (see U.S. Pat. No. 5,208,020 incorporated herein in its entirety), rachelmycin (CC-1065, see U.S. Pat. Nos. 5,475, 092, 5,585,499, and 5,846,545, the contents of each of which are incorporated herein by reference in their entirety), and analogs or homologs thereof. Radioactive ions include, but are not limited to iodine (e.g., $^{125}$iodine or $^{131}$iodine), $^{89}$strontium, phosphorous, palladium, cesium, iridium, phosphate, cobalt, $^{90}$yttrium, $^{153}$samarium, and praseodymium. Other therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thiotepa chlorambucil, rachelmycin (CC-1065), melphalan, carmustine (BSNU), lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids).

In some embodiments, payloads may be detectable agents, such as various organic small molecules, inorganic compounds, nanoparticles, enzymes or enzyme substrates, fluorescent materials, luminescent materials (e.g., luminol), bioluminescent materials (e.g., luciferase, luciferin, and aequorin), chemiluminescent materials, radioactive materials (e.g., $^{18}$F, $^{67}$Ga, $^{81m}$Kr, $^{82}$Rb, $^{111}$In, $^{123}$I, $^{133}$Xe, $^{201}$Tl, $^{125}$I, $^{35}$S, $^{14}$C, $^{3}$H, or $^{99m}$Tc (e.g., as pertechnetate (technetate(VII), TcO$_4^-$)), and contrast agents (e.g., gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn-DPDP), barium sulfate, iodinated contrast media (iohexol), microbubbles, or perfluorocarbons). Such optically-detectable labels include for example, without limitation, 4-acetamido-4'-isothiocyanatostilbene-2,2'disulfonic acid; acridine and derivatives (e.g., acridine and acridine isothiocyanate); 5-(2'-aminoethyl)aminonaphthalene-1-sulfonic acid (EDANS); 4-amino-N-[3-vinylsulfonyl)phenyl]naphthalimide-3,5 disulfonate; N-(4-anilino-1-naphthyl)maleimide; anthranilamide; BODIPY; Brilliant Yellow; coumarin and derivatives (e.g., coumarin, 7-amino-4-methylcoumarin (AMC, Coumarin 120), and 7-amino-4-trifluoromethylcoumarin (Coumarin 151)); cyanine dyes; cyanosine; 4',6-diaminidino-2-phenylindole (DAPI); 5' 5"-dibromopyrogallol-sulfonaphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]-naphthalene-1-sulfonyl chloride (DNS, dansylchloride); 4-dimethylaminophenylazophenyl-4'-isothiocyanate (DABITC); eosin and derivatives (e.g., eosin and eosin isothiocyanate); erythrosin and derivatives (e.g., erythrosin B and erythrosin isothiocyanate); ethidium; fluorescein and derivatives (e.g., 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, X-rhodamine-5-(and-6)-isothiocyanate (QFITC or XRITC), and fluorescamine); 2-[2-[3-[[1,3-dihydro-1,1-dimethyl-3-(3-sulfopropyl)-2H-benz[e]indol-2-ylidene]ethylidene]-2-[4-(ethoxycarbonyl)-1-piperazinyl]-1-cyclopenten-1-yl]ethenyl]-1,1-dimethyl-3-(3-sulforpropyl)-1H-benz[e]indolium hydroxide, inner salt, compound with n,n-diethylethanamine (1:1) (IR144); 5-chloro-2-[2-[3-[(5-chloro-3-ethyl-2(3H)-benzothiazolylidene)ethylidene]-2-(diphenylamino)-1-cyclopenten-1-yl] ethenyl]-3-ethyl benzothiazolium perchlorate (IR140); Malachite Green isothiocyanate; 4-methylumbelliferone orthocresolphthalein; nitrotyrosine; pararosaniline; Phenol Red; B-phycoerythrin; o-phthaldialdehyde; pyrene and derivatives (e.g., pyrene, pyrene butyrate, and succinimidyl 1-pyrene); butyrate quantum dots; Reactive Red 4 (CIBACRON™ Brilliant Red 3B-A); rhodamine and derivatives (e.g., 6-carboxy-X-rhodamine (ROX), 6-carboxyrhodamine (R6G), lissamine rhodamine B sulfonyl chloride rhodamine (Rhod), rhodamine B, rhodamine 123, rhodamine X isothiocyanate, sulforhodamine B, sulforhodamine 101, sulfonyl chloride derivative of sulforhodamine 101 (Texas Red), N,N,N',N'tetramethyl-6-carboxyrhodamine (TAMRA) tetramethyl rhodamine, and tetramethyl rhodamine isothiocyanate (TRITC)); riboflavin; rosolic acid; terbium chelate derivatives; Cyanine-3 (Cy3); Cyanine-5 (Cy5); cyanine-5.5 (Cy5.5), Cyanine-7 (Cy7); IRD 700; IRD 800; Alexa 647; La Jolta Blue; phthalo cyanine; and naphthalo cyanine.

In some embodiments, the detectable agent may be a non-detectable precursor that becomes detectable upon activation (e.g., fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE® (VisEn Medical))). In vitro assays in which the enzyme labeled compositions can be used include, but are not limited to, enzyme linked immunosorbent assays (ELISAs), immunoprecipitation assays, immunofluorescence, enzyme immunoassays (EIA), radioimmunoassays (RIA), and Western blot analysis.

Combinations

In some embodiments, compounds and/or compositions of the present invention may be used in combination with one or more other therapeutic, prophylactic, diagnostic, or imaging agents. By "in combination with," it is not intended to imply that the agents must be administered at the same time and/or formulated for delivery together, although these methods of delivery are within the scope of the present disclosure. Compounds and/or compositions of the present invention may be administered concurrently with, prior to, or subsequent to, one or more other desired therapeutics or medical procedures. In general, each agent will be administered at a dose and/or on a time schedule determined for that agent. In some embodiments, the present disclosure encompasses the delivery of pharmaceutical, prophylactic, diagnostic, or imaging compositions in combination with agents that may improve their bioavailability, reduce and/or modify their metabolism, inhibit their excretion, and/or modify their distribution within the body.

In some cases, compounds and/or compositions of the present invention may be combined with one or more therapeutic agents known in the art. Such agents may include BYM338 (Novartis, Basel, Switzerland,) wherein administration may comprise any of the methods disclosed in clinical trial number NCT01925209 entitled *Efficacy and Safety of Bimagrumab/BYM338 at 52 Weeks on Physical Function, Muscle Strength, Mobility in sIBM Patients (RESILIENT)*. Other agents that may be used in combination with compounds and/or compositions of the present invention may include any of those disclosed in US Pub. No. 2013/0122007, U.S. Pat. No. 8,415,459 or International Pub. No. WO 2011/151432, the contents of each of which are herein incorporated by reference in their entirety.

Dosing and Dosage Forms

The present disclosure encompasses delivery of compounds and/or compositions of the present invention for any of therapeutic, pharmaceutical, diagnostic or imaging by any appropriate route taking into consideration likely advances in the sciences of drug delivery. Delivery may be naked or formulated.

Naked Delivery

Compounds and/or compositions of the present invention may be delivered to cells, tissues, organs and/or organisms in naked form. As used herein in, the term "naked" refers to compounds and/or compositions delivered free from agents or modifications which promote transfection or permeability. The naked compounds and/or compositions may be delivered to the cells, tissues, organs and/or organisms using routes of administration known in the art and described herein. In some embodiments, naked delivery may include formulation in a simple buffer such as saline or PBS.

Formulated Delivery

In some embodiments, compounds and/or compositions of the present invention may be formulated, using methods described herein. Formulations may comprise compounds and/or compositions which may be modified and/or unmodified. Formulations may further include, but are not limited to, cell penetration agents, pharmaceutically acceptable carriers, delivery agents, bioerodible or biocompatible polymers, solvents, and/or sustained-release delivery depots. Formulations of the present invention may be delivered to cells using routes of administration known in the art and described herein.

Compositions may also be formulated for direct delivery to organs or tissues in any of several ways in the art including, but not limited to, direct soaking or bathing, via a catheter, by gels, powder, ointments, creams, gels, lotions, and/or drops, by using substrates such as fabric or biodegradable materials coated or impregnated with compositions, and the like.

Dosing

The present invention provides methods comprising administering one or more compounds and/or compositions to subjects in need thereof. Compounds and/or compositions of the present invention, or prophylactic compositions thereof, may be administered to subjects using any amount and any route of administration effective for preventing, treating, diagnosing, or imaging diseases, disorders and/or conditions. The exact amount required will vary from subject to subject, depending on species, age and/or general subject condition, severity of disease, particular composition, mode of administration, mode of activity, and the like. Compositions in accordance with the invention are typically formulated in dosage unit form for ease of administration and uniformity of dosage. It will be understood, however, that the total daily usage of compositions of the present invention will be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

In certain embodiments, compositions in accordance with the present invention may be administered at dosage levels sufficient to deliver from about 0.0001 mg/kg to about 100 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, prophylactic, or imaging effect. The desired dosage may be delivered three times a day, two times a day, once a day, every other day, every third day, every week, every two weeks, every three weeks, or every four weeks. In certain embodiments, the desired dosage may be delivered using multiple administrations (e.g., two, three, four, five, six, seven, eight, nine, ten, eleven, twelve, thirteen, fourteen, or more administrations).

According to the present invention, compounds and/or compositions of the present invention may be administered in split-dose regimens. As used herein, a "split dose" is the division of single unit dose or total daily dose into two or more doses, e.g., two or more administrations of the single unit dose. As used herein, a "single unit dose" is a dose of any therapeutic administered in one dose/at one time/single route/single point of contact, i.e., single administration event. As used herein, a "total daily dose" is an amount given or prescribed in a 24 hour period. In some embodiments, compounds and/or compositions of the present invention may be administered as a single unit dose. In some embodiments, compounds and/or compositions of the present invention may be administered to subjects in split doses. In some embodiments, compounds and/or compositions of the present invention may be formulated in buffer only or in formulations described herein. Pharmaceutical compositions described herein may be formulated into dosage forms described herein, such as a topical, intranasal, intratracheal, or injectable (e.g., intravenous, intraocular, intravitreal, intramuscular, intracardiac, intraperitoneal, subcutaneous). General considerations in the formulation and/or manufacture of pharmaceutical agents may be found, for example, in Remington: The Science and Practice of Pharmacy $21^{st}$ ed., Lippincott Williams & Wilkins, 2005 (incorporated herein by reference).

Coatings or Shells

Solid dosage forms of tablets, dragees, capsules, pills, and granules can be prepared with coatings and shells such as enteric coatings and other coatings well known in the pharmaceutical formulating art. They may optionally comprise opacifying agents and can be of a composition that they release the active ingredient(s) only, or preferentially, in a certain part of the intestinal tract, optionally, in a delayed manner. Examples of embedding compositions which can be used include polymeric substances and waxes. Solid compositions of a similar type may be employed as fillers in soft and hard-filled gelatin capsules using such excipients as lactose and/or milk sugar as well as high molecular weight polyethylene glycols and the like.

Assays

In some embodiments, recombinant proteins (including, but not limited to chimeric proteins) disclosed herein and/or antibodies directed to such proteins may be developed using assays described herein. In some embodiments, recombinant proteins (including, but not limited to chimeric proteins) disclosed herein and/or antibodies directed to such proteins may be used in assays to develop other recombinant proteins and/or or antibodies of the present invention.

Binding Assays

In some embodiments, the present invention provides binding assays. As used herein, the term "binding assay" refers to an assay used to assess the ability of two or more factors to associate. Such assays may assess the ability of a desired antigen to bind a desired antibody and then use one or more detection methods to detect binding. Binding assays of the invention may include, but are not limited to surface Plasmon resonance-based assays, ELISAs and FACS-based assays. Binding assays of the invention may comprise the use of one or more recombinant proteins described herein, including, but not limited to any TGF-β family member proteins, any chimeric proteins, any cofactors and any modules, combinations or fragments thereof.

Cell-Based Assays

In some embodiments, the present invention provides cell-based assays. As used herein, the term "cell-based assay" refers to an assay comprising at least one aspect that involves the use of a living cell or cell culture. In some embodiments, these may be useful for assessing the modulation of growth factor release from GPCs, referred to herein as "growth factor release assays". In some embodiments, cell-based assays may be useful for assessing the modulation of growth factor activity, referred to herein as "growth factor activity assays". Cell-based assays of the present invention may comprise expression cells and/or responsive cells. Expression cells, as referred to herein, are cells that express one or more factors being analyzed in a particular assay. Such expression may be natural or may be the result of transfection and/or transduction of a foreign gene. In some embodiments, expression of one or more factors by expression cells may be enhanced or suppressed by the addition of one or more exogenous factors. In some embodiments, expression cells may comprise cell lines (e.g. HEK293 cells, CHO cells, TMLC cells, 293T/17 cells, Hs68 cells, CCD1112sk cells, HFF-1 cells, Keloid fibroblasts or Sw-480 cells.) In some embodiments, cell lines comprising expression cells may express one or more recombinant proteins of the present invention (e.g. naturally and/or through transfection, stable transfection, and/or transduction).

In some embodiments, growth factor release/activity assays may comprise expression cells that express GPCs. In such embodiments, additional factors may be co-expressed in and/or combined with expression cells to determine their effect on growth factor release from such GPCs. In some embodiments, integrins (including, but not limited to $\alpha v\beta_6$ integrin, $\alpha v\beta_8$ integrin and/or $\alpha_9\beta_1$ integrin) are co-expressed and/or otherwise introduced to GPC-expressing expression cells. In some embodiments, such additional integrin expression may facilitate growth factor release. In some embodiments, LTBPs, fibrillins and/or GARPs and/or variants thereof are coexpressed and/or otherwise introduced into expression cells.

In some embodiments, one or more genes may be knocked out, knocked down and/or otherwise modulated in expression cells depending on the focus of a particular assay. In some embodiments, one or more gene products may be modulated at the RNA and/or protein level. In some embodiments, gene products may be reduced through the introduction of siRNA molecules to expression cells. In some embodiments, gene products from LTBP, fibrillin and/or GARP genes may be reduced and/or eliminated from expression cells of the present invention.

Cell-based assays of the present invention, including, but not limited to growth factor release/activity assays, may comprise responsive cells. As used herein, the term "responsive cell" refers to a cell that undergoes a response to one or more factors introduced into an assay. In some embodiments, such responses may include a change in gene expression, wherein such cells modulate transcription of one or more genes upon contact with one or more factors introduced. In some embodiments, responsive cells may undergo a change in phenotype, behavior and/or viability.

In some embodiments, responsive cells comprise one or more reporter genes. As used herein, the term "reporter gene" refers to a synthetic gene typically comprising a promoter and a protein coding region encoding one or more detectable gene products. Reporter genes are typically designed in a way such that their expression may be modulated in response to one or more factors being analyzed by a particular assay. This may be carried out by manipulating the promoter of reporter genes. As used herein, the term promoter refers to part of a gene that initiates transcription of that gene. Promoters typically comprise nucleotides at the 3' end of the antisense strand of a given gene and are not transcribed during gene expression. Promoters typically function through interaction with one or more transcription factors as well as RNA polymerase enzymes to initiate transcription of the protein encoding portion of the gene. Segments of the promoter that physically interact with one or more transcription factors and/or polymerase enzymes are referred to herein as response elements. In some embodiments, reporter genes are designed to comprise promoters and/or response elements known to be responsive to one or more factors (including, but not limited to growth factors) being analyzed in a given assay. Changes in responsive cell gene expression may be measured according to any methods available in the art to yield gene expression data. Such gene expression data may be obtained in the form of luciferase activity data [often measured in terms of relative light units (RLUs.)]

In some cases, responsive cells undergo a change in viability in response to one or more factors introduced in an assay. Such responsive cells may be used in proliferation assays as described herein. Changes in responsive cell viability may be detected by cell counting and/or other methods known to those skilled the art to yield responsive cell viability data.

Protein encoding regions of reporter genes typically encode one or more detectable proteins. Detectable proteins refer to any proteins capable of detection through one or more methods known in the art. Such detection methods may include, but are not limited to Western blotting, ELISA, assaying for enzymatic activity of detectable proteins (e.g. catalase activity, β-galactosidase activity and/or luciferase activity,) immunocytochemical detection, surface plasmon resonance detection and/or detection of fluorescent detectable proteins. When a reporter gene is used in an assay, the expression of detectable proteins correlates with the ability of factors being assayed to activate the promoter present in the reporter gene. In embodiments comprising growth factor release/activity assays, reporter gene promoters typically respond to growth factor signaling. In such embodiments, the level of detectable protein produced correlates with level of growth factor signaling, indicating release and/or activity of a given growth factor.

In some embodiments, reporter genes encode luciferase enzymes. Chemical reactions between luciferase enzymes and substrate molecules are light-emitting reactions. Due to such light-emitting reactions, luciferase enzyme levels can be quantified through the addition of substrate molecules and subsequent photodetection of the emitted light. In some embodiments, reporter genes of the present invention encode firefly luciferase, the sequence of which was cloned from *Photinus pyralis*. In some embodiments, responsive cells of the present invention comprise reporter genes that express luciferase with promoters that are responsive to growth factors. In such embodiments, luciferase activity may correlate with growth factor activity levels allowing for growth factor activity and/or release from GPCs to be determined.

In some embodiments, reporter genes are inserted into bacterial plasmids to enable replication and/or facilitate introduction into cells. In some embodiments, such plasmids are designed to comprise sequences encoding detectable gene products and may be manipulated to insert promoter sequences that may be responsive to one or more factors of interest. These plasmids are referred to herein as reporter plasmids. In some embodiments of the present invention, promoters that may be responsive to one or more factors of interest may be inserted into reporter plasmids, upstream of sequences encoding detectable gene products to form functional reporter genes within such reporter plasmids. Reporter plasmids that comprise at least one functional reporter gene are referred to herein as reporter constructs. In some embodiments, reporter constructs of the present invention may comprise pGL2 reporter plasmids (Promega BioSciences, LLC, Madison, Wis.), pGL3 reporter plasmids (Promega BioSciences, LLC, Madison, Wis.), pGL4 reporter plasmids (Promega BioSciences, LLC, Madison, Wis.) or variants thereof. Such reporter constructs express firefly luciferase in response to promoter activation.

In some embodiments, reporter constructs may be introduced directly into expression cells or may be introduced into one or more responsive cells. Responsive cells of the present invention comprising one or more reporter genes are referred to herein as reporter cells. In some embodiments, reporter cells may be transiently transfected with reporter constructs or may comprise stable expression of such constructs (e.g. reporter constructs are successfully replicated along with genomic DNA during each round of cell division). Cell lines that stably comprise reporter constructs are referred to herein as reporter cell lines. In some embodiments, reporter cells are mammalian. In some embodiments, reporter cells may comprise mouse cells, rabbit cells, rat cells, monkey cells, hamster cells and human cells. In some embodiments, cell lines useful for transient and/or stable expression of reporter genes may include, but are not limited to HEK293 cells, HeLa cells, Sw-480 cells, TMLC cells [as disclosed by Abe et al (Abe, M. et al., An assay for transforming growth factor-β using cells transfected with a plasminogen activator inhibitor-1 promoter-luciferase construct. Analytical Biochemistry. 1994. 216:276-84,)] 293T/17 cells, Hs68 cells, CCD1112sk cells, HFF-1 cells, Keloid fibroblasts, A204 cells, L17 RIB cells [as disclosed by Cash et al (Cash, J. N et al., The structure of myostatin:follistatin 288: insights into receptor utilization and heparin binding. The EMBO Journal. 2009. 28:2662-76,)] $C_2C_{12}$ cells and EL4 T lymphoma cells.

In embodiments where one or more reporter cells and/or reporter cell lines are utilized, such cells may be cultured with expression cells as part of a co-culture system. In some embodiments reporter cells/reporter cell lines may be cultured separately from expression cells. In such embodiments, lysates and/or media from expression cells may be combined with reporter cell/reporter cell line cultures to assess expressed factors (including, but not limited to growth factors).

In some embodiments, cell-based assays of the present invention may only comprise expression cells and not responsive cells. In such embodiments, expressed proteins, including but not limited to GPCs and/or growth factors, may be detected by one or more methods that are not cell based. Such methods may include, but are not limited to Western Blotting, enzyme-linked immunosorbent assay (ELISA,) immunocytochemistry, surface plasmon resonance and other methods known in the art for protein detection. In some embodiments, TGF-β release in expression cell cultures and/or culture medium may be detected by ELISA. In some embodiments, such assays may utilize anti-TGF-β antibody, clone 1D11 antibody (R&D Systems, Minneapolis, Minn.) as a capture antibody, capable of recognizing TGF-β isoforms 1, 2 and 3 in multiple species, including, but not limited to cows, chickens, mice and humans. In some embodiments, biotinylated anti-TGF-β1 chicken IgY (BAF240; R&D Systems, Minneapolis, Minn.) may be used as a detection antibody. In some embodiments, GDF-8/myostatin release in expression cell cultures and/or culture medium may be detected by ELISA. In some embodiments, the GDF-8/myostatin quantikine ELISA kit (R&D Systems, Minneapolis, Minn.) may be used.

Examples of anti-GDF-8/myostatin antibodies that may be used for detection include AF1539, MAB788 and AF788 (R&D Systems, Minneapolis, Minn.)

In some embodiments, reporter genes of the present invention comprise growth factor-responsive promoters. As used herein, the term "growth factor-responsive promoter" refers to a gene promoter that facilitates transcription of a downstream gene in response to growth factor cell signaling induced by one or more growth factors. In some embodiments, growth factor-responsive promoters are responsive to TGF-β family member growth factor signaling. In some embodiments, growth factor-responsive promoters of the present invention comprise one or more sequences listed in Table 16 or fragments or variants thereof. These include two versions of the plasminogen activator inhibitor type 1 (PAI-1) promoter [V1 as disclosed by Abe et al (Abe, M. et al., An assay for transforming growth factor-β using cells transfected with a plasminogen activator inhibitor-1 promoter-luciferase construct. Analytical Biochemistry. 1994. 216:276-84) and V2 as disclosed in WO 2011/034935, the contents of which are hereby incorporated by reference in their entirety,] a collagen, type 1, alpha 1 promoter, a collagen, type 1, alpha 2 promoter, a FoxP3 promoter, a CAGA12 promoter [responsive to Smad-dependent signaling as reporter by Thies et al (Thies, R. S. et al., GDF-8 propeptide binds to GDF-8 and antagonizes biological activity by inhibiting GDF-8 receptor binding. Growth Factors. 2001. 18:251-9) and an adenovirus major late promoter.

TABLE 16

Growth factor-responsive promoters

| Promoter | Sequence | SEQ ID NO |
|---|---|---|
| PAI-1 (V1) | AGCTTACCATGGTAACCCCTGGTCCCGTTCAGCCACC ACCACCCCACCCAGCACACCTCCAACCTCAGCCAGAC AAGGTTGTTGACACAAGAGAGCCCTCAGGGGCACAGA GAGAGTCTGGACACGTGGGGAGTCAGCCGTGTATCAT CGGAGGCGGCCGGGCACATGGCAGGGATGAGGGAAAG ACCAAGAGTCCTCTGTTGGGCCCAAGTCCTAGACAGA CAAAACCTAGACAATCACGTGGCTGGCTGCATGCCTG TGGCTGTTGGGCTGGGCAGGAGGAGGGGAGGGGCGCTC TTTCCTGGAGGTGGTCCAGAGCACCGGGTGGACAGCC CTGGGGGAAAACTTCCACGTTTTGATGGAGGTTATCT TTGATAACTCCACAGTGACCTGGTTCGCCAAAGGAAA AGCAGGCAACGTGAGCTGTTTTTTTTTTCTCCAAGCT GAACACTAGGGGTCCTAGGCTTTTTGGGTCACCCGGC ATGGCAGACAGTCAACCTGGCAGGACATCCGGGAGAG ACAGACACAGGCAGAGGGCAGAAAGGTCAAGGGAGGT TCTCAGGCCAAGGCTATTGGGGTTTGCTCAATTGTTC CTGAATGCTCTTACACACGTACACACACAGAGCAGCA CACACACACACACACACATGCCTCAGCAAGTCCCAGA GAGGGAGGTGTCGAGGGGGACCCGCTGGCTGTTCAGA CGGACTCCCAGAGCCAGTGAGTGGGTGGGCTGGAAC ATGAGTTCATCTATTTCCTGCCCACATCTGGTATAAA AGGAGGCAGTGGCCCACAGAGGAGCACAGCTGTGTTT GGCTGCAGGGCCAAGAGCGCTGTCAAGAAGACCCACA CGCCCCCCTCCAGCAGCTG | 258 |
| PAI-1 (V2) | TTGGTCTCCTGTTTCCTTACCAAGCTTTTACCATGGT AACCCCTGGTCCCGTTCAGCCACCACCACCCCACCCA GCACACCTCCAACCTCAGCCAGACAAGGTTGTTGACA CAAGAGAGCCCTCAGGGGCACAGAGAGAGTCTGGACA CGTGGGGAGTCAGCCGTGTATCATCGGAGGCGGCCGG GCACATGGCAGGGATGAGGGAAAGACCAAGAGTCCTC TGTTGGGCCCAAGTCCTAGACAGACAAAACCTAGACA ATCACGTGGCTGGCTGCATGCCTGTGGCTGTTGGGC TGGGCCAGGAGGAGGGAGGGGCGCTCTTTCCTGGAG GTGGTCCAGAGCACCGGGTGGACAGCCCTGGGGAAA ACTTCCACGTTTTGATGGAGGTTATCTTTGATAACTC CACAGTGACCTGGTTCGCCAAAGGAAAAGCAGGCAAC GTGAGCTGTTTTTTTTTCTCCAAGCTGAACACTAGG | 259 |
| | GGTCCTAGGCTTTTTGGGTCACCCGGCATGGCAGACA GTCAACCTGGCAGGACATCCGGGAGAGACAGACACAG GCAGAGGGCAGAAAGGTCAAGGGAGGTTCTCAGGCCA AGGCTATTGGGGTTTGCTCAATTGTTCCTGAATGCTC TTACACACGTACACACACAGAGCAGCACACACACACA CACACACATGCCTCAGCAAGTCCCAGAGAGGGAGGTG TCGAGGGGGACCCGCTGGCTGTTCAGACGGACTCCCA GAGCCAGTGAGTGGGTGGGCTGGAACATGAGTTCAT CTATTTCCTGCCCACATCTGGTATAAAAGGAGGCAGT GGCCCACAGAGGAGCACAGCTGTGTTTGGCTGCAGGG CCAAGAGCGCTGTCAAGAAGACCCACACGCCCCCCTC CAGCAGCTGAATTCCTGCAGCTCAGCAGCCGCCGCCA GAGCAGGACGAACCGCCAATCGCAAGGCACCTCTGAG AACTTCAGGTA | |
| Col1A1 | CCATGGCAAACAAAACTCTTCTCTAAGTCACCAATGA TCACAGGCCTCCCACTAAAAATACTTCCCAACTCTGG GGTGGAAGAGTTTGGGGGATGAATTTTTAGGGGATTG CAAGCCCCAATCCCCACCTCTGTGTCCCTAGAATCCC CCACCCCTACCTTGGCTGCTCCATCACCCAACCACCA AAGCTTTCTTCTGCAGAGGCCACCTAGTCATGTTTCT CACCCTGCACCTCAGCCTCCCCACTCCATCTCTCAAT CATGCCTAGGGTTTGGAGGAAGGCATTTGATTCTGTT CTGGAGCACAGCAGAAGAATTGACATCCTCAAAATTA AAACTCCCTTGCCTGCACCCCTCCCTCAGATATCTGA TTCTTAATGTCTAGAAAGGAATCTGTAAATTGTTCCC CAAATATTCCTAAGCTCCATCCCCTAGCCACACCAGA AGACACCCCCAAACAGGCACATCTTTTTAATTCCCAG CTTCCTCTGTTTTGGAGAGGTCCTCAGCATGCCTCTT TATGCCCCTCCCTTAGCTCTTGCCAGGATATCAGAGG GTGACTGGGGCACAGCCAGGAGGACCCCCTCCCCAAC ACCCCCAACCCTTCCACCTTTGGAAGTCTCCCCACCC AGCTCCCCAGTTCCCCAGTTCCACTTCTTCTAGATTG GAGGTCCAGGAAGAGAGCAGAGGGGCACCCCTACCC ACTGGTTAGCCCACGCCATTCTGAGGACCCAGCTGCA CCCCTACCACAGCACCTCTGGCCCAGGCTGGGCTGGG GGGCTGGGGAGGCAGAGCTGCGAAGAGGGGAGATGTG GGGTGGACTCCCTTCCCTCCTCCTCCCCCTCTCCATT CCAACTCCCAAATTGGGGGCCGGGCCAGGCAGCTCTG ATTGGCTGGGGCACGGGCGGCCGGCTCCCCCTCTCCG AGGGGCAGGGTTCCTCCCTGCTCTCCATCAGGACAGT ATAAAAGGGGCCCGGGCCAGTCGTCGGAGCAGACGGG AGTTTCTCCTCGGGGTCGGAGCAGGAGGCACGCGGAG TGTGAGGCCACGCATGAGCGGACGCTAACCCCCTCCC CAGCCACAAAGAGTCTACATG | 260 |
| Col1A2 | TAGAGTTCGCAAAGCCTATCCTCCCTGTAGCCGGGTG CCAAGCAGCCTCGAGCCTGCTCCCCAGCCCACCTGCC AACAAAAGGCGCCCTCCGACTGCAACCCAGCCCTCCA CAGACAGGACCCGCCCTTTCCCGAAGTCATAAGACAA AGAGAGTGCATCACTGCTGAAACAGTGGCGCACACG AGCCCCAAAGCTAGAGAAAAGCTGGACGGGGCTGGGG GCGGGGTGCAGGGGTGGAGGGGCGGGAGGCGGGCTC CGGCTGCGCCACGCTATCGAGTCTTCCCTCCCTCCTT CTCTGCCCCCTCCGCTCCCGCTGGAGCCCTCCACCCT ACAAGTGGCCTACAGGGCACAGGTGAGGCGGACTGG ACAGCTCCTGCTTTGATCGCCGGAGATCTGCAAATTC TGCCCATGTCGGGGCTGCAGAGCACTCCGACGTGTCC CATAGTGTTTCCAAACTTGGAAAGGGCGGGGGAGGGC GGGAGGATGCGGAGGGCGGAGGTATGCAGACAACGAG TCAGAGTTTCCCCTTGAAAGCCTCAAAAGTGTCCACG TCCTCAAAAAGAATGGAACCAATTTAAGAAGCCAGCC CCGTGGCCACGTCCCTTCCCCCATTCGCTCCCTCCTC TGCGCCCCCGCAGGCTCCTCCCAGCTGTGGCTGCCCG GGCCCCCAGCCCCAGCCCTCCCATTGGTGGAGGCCCT TTTGGAGGCACCCTAGGGCCAGGGAAACTTTTGCCGT ATAAATAGGGCAGATCCGGGCTTTATTATTTTAGCAC CACGGCAGCAGGAGGTTTCGGCTAAGTTGGAGGTACT GGCCACGACTGCATGCCCGCGCCCGCCAGGTGATACC TCCGCCGGTGACCCAGGGGCTCTGCGACACAAGGAGT CTGCATGTCTAAGTGCTAGACATGCTCAGCTTTGTGG ATACGCGGACTTTGTTGCTGCTTGCAGTAA | 261 |

TABLE 16-continued

Growth factor-responsive promoters

| Promoter | Sequence | SEQ ID NO |
|---|---|---|
| FoxP3 | AGTAAAAGACCCCAAAGGCTGAGGGCCTCAGAAGCAT CAGGCCATGATGTTCCTGAAACAAGAGGGTCAGGGTC CCAATGGGCCTCTGGGGTTCATCGTGAGGATGGATGC ATTAATATTGGGGACCTGCTAGGGACCTTCCCAGTGG GACAGTGGCTGGGTCAGGGCACTCAAGCCCTAAAACG TGATGAGGCGAGACTTTTCTCTCTTTCCTCATTCAGT AACTGTCAGTAGATTCTGGGAGCCAGGGATTCTCCGA CTCTTCAAGTCCATGAATTTTAGGGGATGACAGTGGG CTCTCCGCTTTCTCCTCCATGAAGTAACTTACATGCC CCTCACCCTCTGTGGGAGGGGTGTTGCAGGGGGTGCA GAACTCCCCTCGCCGGGTAGTTCAAGCAATGGGGACC ATATCAATTCCATCTATAGGGAAACTGAGGCCTGGAG TAGGGCGAGGCCTCTGGGAACCCAGCCCTATTCTGTC TCTTTCCCTGGCATTTCCCATCCACACATAGAGCTTC AGATTCTCTTTCTTTCCCCAGAGACCCTCAAATATCC TCTCACTCACAGAATGGTGTCTCTGCCTGCCTCGGGT TGGCCCTGTGATTTATTTTAGTTCTTTTCCCTTGTTT TTTTTTTTTCAAACTCTATACACTTTTGTTTTAAAAA CTGTGGTTTCTCATGAGCCCTATTATCTCATTGATAC CTCTCACCTCTGTGGTGAGGGGAAGAAATCATATTTT CAGATGACTCGTAAAGGGCAAAGAAAAAAACCCAAAA TTTCAAAATTTCCGTTTAAGTCTCATAATCAAGAAAA GGAGAAACACAGAGAGAGAGAAAAAAAAAAACTATGAG AACCCCCCCCACCCCGTGATTATCAGCGCACACACT CATCGAAAAAATTTGGATTATTAGAAGAGAGAGGTC TGCGGCTTCCACACCGTACAGCGTGGTTTTTCTTCTC GGTATAAAAGCAAAGTTGTTTTTGATACGTGACAGTT TCCCACAAGCCAGGCTGATCCTTTTCTGTCAGTCCAC TTCACCA | 262 |
| CAGA12 | AGCCAGACAAGCCAGACAAGCCAGACAAGCCAGACAA GCCAGACAAGCCAGACAAGCCAGACAAGCCAGACAAG CCAGACAAGCCAGACAAGCCAGACAAGCCAGACA | 263 |
| Adenovirus major late promoter | GGGCTATAAAAGGGGTGGGGGCGCGTTCGTCCTCAC TCTCTTCCG | 264 |

In some embodiments, mink lung epithelial/PAI reporter cell lines may be used. Mink lung epithelial cells do not produce TGF-β, but do express high levels of TGF-β receptors (Munger et al.) Mink lung epithelial/PAI reporter cell lines may comprise reporter constructs comprising promoter elements from the TGF-β-responsive genes PAI and/or COLLA that modulate the expression of the protein coding portion of the luciferase gene. In some embodiments, other reporter constructs may be used with mink lung epithelial cells. In some embodiments, SMAD3-responsive reporter constructs may be used.

TGF-β2 Release Assay

In some embodiments, the present invention provides assays for detecting the release and/or activity of TGF-β2. Such assays may comprise cell lines (e.g. HEK293 cells, 293T/17 cells, Hs68 cells, CCD1112sk cells, HFF-1 cells, Keloid fibroblasts or Sw-480 cells) that express GPCs comprising TGF-β2 (e.g. naturally and/or through transfection, stable transfection, and/or transduction) and/or recombinant and/or chimeric protein derivatives thereof. In some embodiments, additional factors are expressed in and/or combined with TGF-β2-expressing cells to determine their effect on TGF-β2 growth factor release. In some embodiments, integrins may be expressed. In some embodiments, $\alpha_9\beta_1$ integrin may be expressed.

In some embodiments, TGF-β2 release may be detected by one or more growth factor release assays according to those described herein. In some embodiments, such assays may comprise the use of mink lung epithelial/PAI reporter cell lines to measure TGF-β2 release and/or activity. In some embodiments, TGF-β2 release assays may be used to screen antibodies for inhibitory and/or activating properties with regard to TGF-β2 release from GPCs and/or activity $T_{reg}$ Induction Assay $T_{reg}$ cells are immune cells that comprise a suppressor cell function important in regulating autoimmunity. Such cells are derived from precursor cells after the induction of the FoxP3 gene (Wood and Sakaguchi, Nature Reviews, 2003). FoxP3 is a transcription factor, the expression of which may be regulated to some degree by TGF-β-related proteins. Wan and Flavell (2005) demonstrated that in response to exogenous TGF-β, activated primary T cells show de novo FoxP3 and "knocked-in" fluorescent protein expression and induction of suppressor cell function. Tone et al (2008) demonstrated that key TGF-β responsive enhancer elements that drive FoxP3 expression in primary T cells are present in the EL4 T lymphoma line. In some embodiments, the present invention provides reporter constructs comprising promoter elements from the FoxP3 gene that modulate expression of such reporter constructs (referred to herein as FoxP3-driven reporter constructs). In some embodiments, FoxP3-driven reporter constructs comprise promoter elements responsive to TGF-β-related protein cell signaling activity. In some embodiments, FoxP3-driven reporter constructs are introduced (transiently and/or stably) to one or more cells and/or cell lines. Such cells are referred to herein as FoxP3-driven reporter cells. In some embodiments, such cells are mammalian. In some embodiments, such mammalian cells may include, but are not limited to mouse cells, rabbit cells, rat cells, monkey cells, hamster cells and human cells. Such cells may be derived from a cell line. In some embodiments, human cells may be used. In some embodiments, cell lines may include, but are not limited to HEK293 cells, HeLa cells, Sw-480 cells, EL4 T lymphoma cells, TMLC cells, 293T/17 cells, Hs68 cells, CCD1112sk cells, HFF-1 cells, Keloid fibroblasts, A204 cells, L17 RIB cells and $C_2C_{12}$ cells. In some embodiments, EL4 T lymphoma cells may be used. EL4 T lymphoma cells are known to comprise transcriptional enhancer elements that are responsive to TGF-β-related protein signaling. In some embodiments, FoxP3-driven reporter cells may be used to screen antibodies for their ability to activate and/or inhibit FoxP3-dependent gene expression.

Proliferation Assays

In some embodiments, cell-based assays of the present invention may comprise proliferation assays. As used herein, the term "proliferation assay" refers to an assay that determines the effect on one or more agents on cell proliferation.

In some cases, proliferation assays may comprise HT2 proliferation assays. Such assays may be carried out, for example, according to the methods described in Tsang, M. et al., 1995. Cytokine 7(5):389-97, the contents of which are herein incorporated by reference in their entirety. HT2 cells (ATCC CRL-1841) are grown in the presence of IL-2, in which they are insensitive to TGF-β1 in the culture media. When HT2 cells are switched into IL-4-containing media they will continue to proliferate, but will respond to TGF-β1 in the culture media by induction of apoptosis. In IL-4 containing media, cell death due to TGF-β1 in culture media occurs in a dose dependent manner, which can be blocked by numerous reagents interfering with the TGF-β signaling pathway. This enables the use of this assay to screen reagents to modulate TGF-β1 activation.

Detection of changes in cell number may be carried out, in some embodiments, through the detection and/or quantification of ATP levels in cells. ATP levels typically correlate with the number of cells present in a given test sample, well, plate or dish. In some embodiments, ATP levels may be determined using a CELLTITER-GLO® Luminescent Cell Viability Assay (Promega BioSciences, LLC, Madison, Wis.).

Kits and Devices

Any of the compounds and/or compositions of the present invention may be comprised in a kit. In a non-limiting example, reagents for generating compounds and/or compositions, including antigen molecules are included in one or more kit. In some embodiments, kits may further include reagents and/or instructions for creating and/or synthesizing compounds and/or compositions of the present invention. In some embodiments, kits may also include one or more buffers. In some embodiments, kits of the invention may include components for making protein or nucleic acid arrays or libraries and thus, may include, for example, solid supports.

In some embodiments, kit components may be packaged either in aqueous media or in lyophilized form. The container means of the kits will generally include at least one vial, test tube, flask, bottle, syringe or other container means, into which a component may be placed, and preferably, suitably aliquotted. Where there are more than one kit component, (labeling reagent and label may be packaged together), kits may also generally contain second, third or other additional containers into which additional components may be separately placed. In some embodiments, kits may also comprise second container means for containing sterile, pharmaceutically acceptable buffers and/or other diluents. In some embodiments, various combinations of components may be comprised in one or more vial. Kits of the present invention may also typically include means for containing compounds and/or compositions of the present invention, e.g., proteins, nucleic acids, and any other reagent containers in close confinement for commercial sale. Such containers may include injection or blow-molded plastic containers into which desired vials are retained.

In some embodiments, kit components are provided in one and/or more liquid solutions. In some embodiments, liquid solutions are aqueous solutions, with sterile aqueous solutions being particularly preferred. In some embodiments, kit components may be provided as dried powder(s). When reagents and/or components are provided as dry powders, such powders may be reconstituted by the addition of suitable volumes of solvent. In some embodiments, it is envisioned that solvents may also be provided in another container means. In some embodiments, labeling dyes are provided as dried powders. In some embodiments, it is contemplated that 10, 20, 30, 40, 50, 60, 70, 80, 90, 100, 120, 120, 130, 140, 150, 160, 170, 180, 190, 200, 300, 400, 500, 600, 700, 800, 900, 1000 micrograms or at least or at most those amounts of dried dye are provided in kits of the invention. In such embodiments, dye may then be resuspended in any suitable solvent, such as DMSO.

In some embodiments, kits may include instructions for employing kit components as well the use of any other reagent not included in the kit. Instructions may include variations that may be implemented.

In some embodiments, compounds and/or compositions of the present invention may be combined with, coated onto or embedded in a device. Devices may include, but are not limited to, dental implants, stents, bone replacements, artificial joints, valves, pacemakers and/or other implantable therapeutic device.

DEFINITIONS

At various places in the present specification, substituents of compounds of the present disclosure are disclosed in groups or in ranges. It is specifically intended that the present disclosure include each and every individual subcombination of the members of such groups and ranges. The following is a non-limiting list of term definitions.

Activity: As used herein, the term "activity" refers to the condition in which things are happening or being done. Compositions of the invention may have activity and this activity may involve one or more biological events. In some embodiments, such biological event may involve growth factors and/or growth factor signaling. In some embodiments, biological events may include cell signaling events associated with growth factor and receptor interactions. In some embodiments, biological events may include cell signaling events associated with TGF-β or TGF-β-related protein interactions with one or more corresponding receptors.

Administered in combination: As used herein, the term "administered in combination" or "combined administration" refers to simultaneous exposure of one or more subjects to two or more agents administered at the same time or within an interval such that the subject is at some point in time simultaneously exposed to both and/or such that there may be an overlap in the effect of each agent on the patient. In some embodiments, at least one dose of one or more agents is administered within about 24 hours, 12 hours, 6 hours, 3 hours, 1 hour, 30 minutes, 15 minutes, 10 minutes, 5 minutes, or 1 minute of at least one dose of one or more other agents. In some embodiments, administration occurs in overlapping dosage regimens. As used herein, the term "dosage regimen" refers to a plurality of doses spaced apart in time. Such doses may occur at regular intervals or may include one or more hiatus in administration. In some embodiments, the administration of individual doses of one or more compounds and/or compositions of the present invention, as described herein, are spaced sufficiently closely together such that a combinatorial (e.g., a synergistic) effect is achieved.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Antigens of interest or desired antigens: As used herein, the terms "antigens of interest" or "desired antigens" refers to those proteins and/or other biomolecules provided herein that are immunospecifically bound or interact with antibodies of the present invention and/or fragments, mutants, variants, and/or alterations thereof described herein. In some embodiments, antigens of interest may comprise TGF-β-related proteins, growth factors, prodomains, GPCs, protein modules or regions of overlap between them.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered,"

when used with respect to two or more moieties, mean that the moieties are physically associated or connected with one another, either directly or via one or more additional moieties that serve as linking agents, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Biomolecule: As used herein, the term "biomolecule" is any natural molecule which is amino acid-based, nucleic acid-based, carbohydrate-based or lipid-based, and the like.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, a compounds and/or compositions of the present invention may be considered biologically active if even a portion of is biologically active or mimics an activity considered to biologically relevant.

Biological system: As used herein, the term "biological system" refers to a group of organs, tissues, cells, intracellular components, proteins, nucleic acids, molecules (including, but not limited to biomolecules) that function together to perform a certain biological task within cellular membranes, cellular compartments, cells, tissues, organs, organ systems, multicellular organisms, or any biological entity. In some embodiments, biological systems are cell signaling pathways comprising intracellular and/or extracellular cell signaling biomolecules. In some embodiments, biological systems comprise growth factor signaling events within the extracellular matrix, cellular matrix and/or cellular niches.

Candidate antibody: As used herein, the term "candidate antibody" refers to an antibody from a pool of one or more antibody from which one or more desired antibodies may be selected.

Cellular matrix: As used herein, the term "cellular matrix" refers to the biochemical and structural environment associated with the outer portion of the cell membrane. Such cell membranes may also include platelet membranes. Components of the cellular matrix may include, but are not limited to proteoglycans, carbohydrate molecules, integral membrane proteins, glycolipids and the like. In some cases, cellular matrix components may include growth factors and/or modulators of growth factor activity. Some cellular matrix proteins include integrins, GARP and LRRC33.

Compound: As used herein, the term "compound," refers to a distinct chemical entity The term may be used herein to refer to peptides, proteins, protein complexes or antibodies of the invention. In some embodiments, a particular compound may exist in one or more isomeric or isotopic forms (including, but not limited to stereoisomers, geometric isomers and isotopes). In some embodiments, a compound is provided or utilized in only a single such form. In some embodiments, a compound is provided or utilized as a mixture of two or more such forms (including, but not limited to a racemic mixture of stereoisomers). Those of skill in the art appreciate that some compounds exist in different such forms, show different properties and/or activities (including, but not limited to biological activities). In such cases it is within the ordinary skill of those in the art to select or avoid particular forms of the compound for use in accordance with the present invention. For example, compounds that contain asymmetrically substituted carbon atoms can be isolated in optically active or racemic forms. Methods on how to prepare optically active forms from optically active starting materials are known in the art, such as by resolution of racemic mixtures or by stereoselective synthesis.

Conserved: As used herein, the term "conserved" refers to nucleotides or amino acid residues of polynucleotide or polypeptide sequences, respectively, that are those that occur unaltered in the same position of two or more sequences being compared. Nucleotides or amino acids that are relatively conserved are those that are conserved among more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an oligonucleotide or polypeptide or may apply to a portion, region or feature thereof.

In one embodiment, conserved sequences are not contiguous. Those skilled in the art are able to appreciate how to achieve alignment when gaps in contiguous alignment are present between sequences, and to align corresponding residues not withstanding insertions or deletions present.

Delivery: As used herein, "delivery" refers to the act or manner of delivering a compound, substance, entity, moiety, cargo or payload.

Delivery Agent: As used herein, "delivery agent" refers to any agent which facilitates, at least in part, the in vivo delivery of one or more substances (including, but not limited to a compounds and/or compositions of the present invention) to a cell, subject or other biological system cells.

Desired antibody: As used herein, the term "desired antibody" refers to an antibody that is sought after, in some cases from a pool of candidate antibodies.

Destabilized: As used herein, the term "destable," "destabilize," or "destabilizing region" means a region or molecule that is less stable than a starting, reference, wild-type or native form of the same region or molecule.

Detectable label: As used herein, "detectable label" refers to one or more markers, signals, or moieties which are attached, incorporated or associated with another entity, which markers, signals or moieties are readily detected by methods known in the art including radiography, fluorescence, chemiluminescence, enzymatic activity, absorbance, immunological detection and the like. Detectable labels may include radioisotopes, fluorophores, chromophores, enzymes, dyes, metal ions, ligands, biotin, avidin, streptavidin and haptens, quantum dots, polyhistidine tags, myc tags, flag tags, human influenza hemagglutinin (HA) tags and the like. Detectable labels may be located at any position in the entity with which they are attached, incorporated or associated. For example, when attached, incorporated in or associated with a peptide or protein, they may be within the amino acids, the peptides, or proteins, or located at the N- or C-termini.

Distal: As used herein, the term "distal" means situated away from the center or away from a point or region of interest.

Engineered: As used herein, embodiments of the invention are "engineered" when they are designed to have a feature or property, whether structural or chemical, that varies from a starting point, wild type or native molecule. Thus, engineered agents or entities are those whose design and/or production include an act of the hand of man.

Epitope: As used herein, an "epitope" refers to a surface or region on a molecule that is capable of interacting with components of the immune system, including, but not limited to antibodies. In some embodiments, when referring to a protein or protein module, an epitope may comprise a linear stretch of amino acids or a three dimensional structure formed by folded amino acid chains.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; (4) folding of a polypeptide or protein; and (5) post-translational modification of a polypeptide or protein.

Extracellular matrix: As used herein, the term, "extracellular matrix," or "ECM" refers to the area surrounding cells and/or the area between cells that typically comprises structural proteins as well as cell signaling molecules. Components of the extracellular matrix may include, but are not limited to proteins, nucleic acids, membranes, lipids and sugars that may be directly or indirectly associated with structural components of the extracellular environments. Structural components of the extracellular matrix may include, but are not limited to proteins, polysaccharides (e.g. hyaluronic acid,) glycosaminoglycans and proteoglycans (e.g. heparin sulfate, chondroitin sulfate and keratin sulfate.) Such structural components may include, but are not limited to fibrous components (e.g. collagens and elastins,) fibrillins, fibronectin, laminins, agrin, perlecan, decorin and the like. Other proteins that may be components of the extracellular matrix include and LTBPs. Extracellular matrix components may also include growth factors and/or modulators of growth factor activity.

Feature: As used herein, a "feature" refers to a characteristic, a property, or a distinctive element.

Formulation: As used herein, a "formulation" includes at least a compound and/or composition of the present invention and a delivery agent.

Fragment: A "fragment," as used herein, refers to a portion. For example, fragments of proteins may comprise polypeptides obtained by digesting full-length protein isolated from cultured cells. In some embodiments, a fragment of a protein includes at least 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, 250 or more amino acids. In some embodiments, fragments of an antibody include portions of an antibody subjected to enzymatic digestion or synthesized as such.

Functional: As used herein, a "functional" biological molecule is a biological entity with a structure and in a form in which it exhibits a property and/or activity by which it is characterized.

Homology: As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is typically determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids. In many embodiments, homologous protein may show a large overall degree of homology and a high degree of homology over at least one short stretch of at least 3, 4, 5, 6, 7, 8, 9, 10, 11, 12, 13, 14, 15, 16, 17, 18, 19, 20, 25, 30, 35, 40, 45, 50 or more amino acids. In many embodiments, homologous proteins share one or more characteristic sequence elements. As used herein, the term "characteristic sequence element" refers to a motif present in related proteins. In some embodiments, the presence of such motifs correlates with a particular activity (such as biological activity).

Identity: As used herein, the term "identity" refers to the overall relatedness between polymeric molecules, e.g., between oligonucleotide molecules (e.g. DNA molecules and/or RNA molecules) and/or between polypeptide molecules. Calculation of the percent identity of two polynucleotide sequences, for example, may be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined, for example using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research*, 12(1), 387 (1984)), BLASTP, BLASTN, and FASTA Altschul, S. F. et al., *J. Molec. Biol.*, 215, 403 (1990)).

Inhibit expression of a gene: As used herein, the phrase "inhibit expression of a gene" means to cause a reduction in the amount of an expression product of the gene. The expression product may be RNA transcribed from the gene (e.g. mRNA) or a polypeptide translated from mRNA transcribed from the gene. Typically a reduction in the level of mRNA results in a reduction in the level of a polypeptide translated therefrom. The level of expression may be determined using standard techniques for measuring mRNA or protein.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" is synonymous with "separated", but carries with it the inference separation was carried out by the hand of man. In one embodiment, an isolated substance or entity is one that has been separated from at least some of the components with which it was previously associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art. In some embodiments, isolation of a substance or entity includes disruption of chemical associations and/or bonds. In some embodiments, isolation includes only the separation from components with which the isolated substance or entity was previously combined and does not include such disruption.

Linker: As used herein, a linker refers to a moiety that connects two or more domains, moieties or entities. In one embodiment, a linker may comprise 10 or more atoms. In a further embodiment, a linker may comprise a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. In some embodiments, a linker may comprise one or more nucleic acids comprising one or more nucleotides. In some embodiments, the linker may comprise an amino acid, peptide, polypeptide or protein. In some embodiments, a moiety bound by a linker may include, but is not limited to an atom, a chemical group, a nucleoside, a nucleotide, a nucleobase, a sugar, a nucleic acid, an amino acid, a peptide, a polypeptide, a protein, a protein complex, a payload (e.g., a therapeutic agent). or a marker (including, but not limited to a chemical, fluorescent, radioactive or bioluminescent marker). The linker can be used for any useful purpose, such as to form multimers or conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N=N—), which can be cleaved using a reducing agent or photolysis. Non-limiting examples of a selectively cleavable bonds include an amido bond which may be cleaved for example by the use of tris(2-carboxyethyl)phosphine (TCEP), or other reducing agents, and/or photolysis, as well as an ester bond which may be cleaved for example by acidic or basic hydrolysis.

Modified: As used herein, the term "modified" refers to a changed state or structure of a molecule or entity as compared with a parent or reference molecule or entity. Molecules may be modified in many ways including chemically, structurally, and functionally. In some embodiments, compounds and/or compositions of the present invention are modified by the introduction of non-natural amino acids.

Mutation: As used herein, the term "mutation" refers to a change and/or alteration. In some embodiments, mutations may be changes and/or alterations to proteins (including peptides and polypeptides) and/or nucleic acids (including polynucleic acids). In some embodiments, mutations comprise changes and/or alterations to a protein and/or nucleic acid sequence. Such changes and/or alterations may comprise the addition, substitution and or deletion of one or more amino acids (in the case of proteins and/or peptides) and/or nucleotides (in the case of nucleic acids and or polynucleic acids). In embodiments wherein mutations comprise the addition and/or substitution of amino acids and/or nucleotides, such additions and/or substitutions may comprise 1 or more amino acid and/or nucleotide residues and may include modified amino acids and/or nucleotides.

Naturally occurring: As used herein, "naturally occurring" means existing in nature without artificial aid, or involvement of the hand of man.

Niche: As used herein, the term "niche" refers to a place, zone and/or habitat. In some embodiments, niches comprise cellular niches. As used herein, the term "cell niche" refers to a unique set of physiologic conditions in a cellular system within a tissue, organ or organ system within or derived from a mammalian organism. A cell niche may occur in vivo, in vitro, ex vivo, or in situ. Given the complex nature and the dynamic processes involved in growth factor signaling, a cell niche may be characterized functionally, spatially or temporally or may be used to refer to any environment that encompasses one or more cells. As such, in some embodiments a cell niche includes the environment of any cell adjacent to another cell that provides support, such as for example a nurse cell. In some embodiments, niches may include those described in U.S. Provisional Patent Applications 61/722,919, filed Nov. 6, 2012 and 61/722,969, filed Nov. 6, 2012, the contents of each of which are herein incorporated by reference in their entireties.

Non-human vertebrate: As used herein, a "non-human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Off-target: As used herein, "off target" refers to any unintended effect on any one or more target, gene and/or cellular transcript.

Operably linked: As used herein, the phrase "operably linked" refers to a functional connection between two or more molecules, constructs, transcripts, entities, moieties or the like.

Paratope: As used herein, a "paratope" refers to the antigen-binding site of an antibody.

Passive adsorption: As used herein, "passive adsorption" refers to a method of immobilizing solid-phase reactants on one or more surfaces (e.g. membranes, dishes, culture dishes, assay plates, etc.) Immobilization typically occurs due to affinity between such reactants and surface components.

Patient: As used herein, "patient" refers to a subject who may seek or be in need of treatment, requires treatment, is receiving treatment, will receive treatment, or a subject who is under care by a trained (e.g., licensed) professional for a particular disease or condition.

Peptide: As used herein, the term "peptide" refers to a chain of amino acids that is less than or equal to about 50 amino acids long, e.g., about 5, 10, 15, 20, 25, 30, 35, 40, 45, or 50 amino acids long.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: As used herein, the term "pharmaceutically acceptable excipient," as used herein, refers to any ingredient other than active agents (e.g., as described herein) present in pharmaceutical compositions and having the properties of being substantially nontoxic and non-inflammatory in subjects. In some embodiments, pharmaceutically acceptable excipients are vehicles capable of suspending and/or dissolving active agents. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: Pharmaceutically acceptable salts of the compounds described herein are forms of the disclosed compounds wherein the acid or base moiety is in its salt form (e.g., as generated by reacting a free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. Pharmaceutically acceptable salts include the conventional non-toxic salts, for example, from non-toxic inorganic or organic acids. In some embodiments a pharmaceutically acceptable salt is prepared from a parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, 17$^{th}$ ed., Mack Publishing Company, Easton, Pa., 1985, p. 1418, *Pharmaceutical Salts: Properties*, Selection, and Use, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety. Pharmaceutically acceptable solvate: The term "pharmaceutically acceptable solvate," as used herein, refers to a crystalline form of a compound wherein molecules of a suitable solvent are incorporated in the crystal lattice. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate." In some embodiments, the solvent incorporated into a solvate is of a type or at a level that is physiologically tolerable to an organism to which the solvate is administered (e.g., in a unit dosage form of a pharmaceutical composition).

Pharmacokinetic: As used herein, "pharmacokinetic" refers to any one or more properties of a molecule or compound as it relates to the determination of the fate of substances administered to living organisms. Pharmacokinetics are divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity which is in a form predicate for that substance, molecule or entity to act as a therapeutic upon chemical or physical alteration. Prodrugs may be covalently bonded or sequestered in some way until converted into the active drug moiety prior to, upon or after administration to a mammalian subject. Prodrugs can be prepared by modifying functional groups present in the compounds in such a way that the modifications are cleaved, either in routine manipulation or in vivo, to the parent compounds. Prodrugs include compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Pro-drugs as Novel Delivery Systems," Vol. 14 of the A.C.S. Symposium Series, and in *Bioreversible Carriers in Drug Design*, ed. Edward B. Roche, American Pharmaceutical Association and Pergamon Press, 1987, both of which are hereby incorporated by reference in their entirety.

Proliferate: As used herein, the term "proliferate" means to grow, expand, replicate or increase or cause to grow, expand, replicate or increase. "Proliferative" means having the ability to proliferate. "Anti-proliferative" means having properties counter to or in opposition to proliferative properties.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Purified: As used herein, the term "purify" means to make substantially pure or clear from unwanted components, material defilement, admixture or imperfection. "Purified" refers to the state of being pure. "Purification" refers to the process of making pure.

Region: As used herein, the term "region" refers to a zone or general area. In some embodiments, when referring to a protein or protein module, a region may comprise a linear sequence of amino acids along the protein or protein module or may comprise a three dimensional area, an epitope and/or a cluster of eptiopes. In some embodiments, regions comprise terminal regions. As used herein, the term "terminal region" refers to regions located at the ends or termini of a given agent. When referring to proteins, terminal regions may comprise N- and/or C-termini. N-termini refer to the end of a protein comprising an amino acid with a free amino group. C-termini refer to the end of a protein comprising an amino acid with a free carboxyl group. N- and/or C-terminal regions may there for comprise the N- and/or C-termini as well as surrounding amino acids. In some embodiments, N- and/or C-terminal regions comprise from about 3 amino acid to about 30 amino acids, from about 5 amino acids to about 40 amino acids, from about 10 amino acids to about 50 amino acids, from about 20 amino acids to about 100 amino acids and/or at least 100 amino acids. In some embodiments, N-terminal regions may comprise any length of amino acids that includes the N-terminus, but does not include the C-terminus. In some embodiments, C-terminal regions may comprise any length of amino acids, that include the C-terminus, but do not comprise the N-terminus.

Region of antibody recognition: As used herein, the term "region of antibody recognition" refers to one or more regions on one or more antigens or between two or more antigens that are specifically recognized and bound by corresponding antibodies. In some embodiments, regions of antibody recognition may comprise 1, 2, 3, 4, 5, 6, 7, 8, 9 or at least 10 amino acid residues. In some embodiments, regions of antibody recognition comprise a junction between two proteins or between two domains of the same protein that are in close proximity to one another.

Sample: As used herein, the term "sample" refers to an aliquot or portion taken from a source and/or provided for analysis or processing. In some embodiments, a sample is from a biological source such as a tissue, cell or component part (e.g. a body fluid, including but not limited to blood, mucus, lymphatic fluid, synovial fluid, cerebrospinal fluid, saliva, amniotic fluid, amniotic cord blood, urine, vaginal fluid and semen). In some embodiments, a sample may be or comprise a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. In some embodiments, a sample is or comprises a medium, such as a nutrient broth or gel, which may contain cellular components, such as proteins or nucleic acid molecule. In some embodiments, a "primary" sample is an aliquot of the source. In some embodiments, a primary sample is subjected to one or more processing (e.g., separation, purification, etc.) steps to prepare a sample for analysis or other use.

Signal Sequences: As used herein, the phrase "signal sequences" refers to a sequence which can direct the transport or localization of a protein.

Single unit dose: As used herein, a "single unit dose" is a dose of any therapeutic administered in one dose/at one time/single route/single point of contact, i.e., single administration event. In some embodiments, a single unit dose is provided as a discrete dosage form (e.g., a tablet, capsule, patch, loaded syringe, vial, etc.).

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound or entity that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable. In some embodiments, stability is measured relative to an absolute value. In some embodiments, stability is measured relative to a reference compound or entity.

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term typically means within about 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Synthetic: The term "synthetic" means produced, prepared, and/or manufactured by the hand of man. Synthesis of polynucleotides or polypeptides or other molecules of the present invention may be chemical or enzymatic.

Targeted Cells: As used herein, "targeted cells" refers to any one or more cells of interest. The cells may be found in vitro, in vivo, in situ or in the tissue or organ of an organism. The organism may be an animal, preferably a mammal, more preferably a human and most preferably a patient.

Target site: The term "target site" as used herein, refers to a region or area targeted by a given compound, composition or method of the invention. Target sites may include, but are not limited to cells, tissues, organs, organ systems, niches and the like.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition. In some embodiments, a therapeutically effective amount is provided in a single dose. In some embodiments, a therapeutically effective amount is administered in a dosage regimen comprising a plurality of doses. Those skilled in the art will appreciate that in some embodiments, a unit dosage form may be considered to comprise a therapeutically effective amount of a particular agent or entity if it comprises an amount that is effective when administered as part of such a dosage regimen.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in a 24 hr period. It may be administered as a single unit dose.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Unmodified: As used herein, "unmodified" refers to any substance, compound or molecule prior to being changed in any way. Unmodified may, but does not always, refer to the wild type or native form of a biomolecule or entity. Molecules or entities may undergo a series of modifications whereby each modified product may serve as the "unmodified" starting molecule or entity for a subsequent modification.

EQUIVALENTS AND SCOPE

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

Section and table headings are not intended to be limiting.

Examples

Example 1

Protein Expression System

Protein expression is carried out using 293E cells. 293E cells are HEK293 cells stably expressing EBNA1 (Epstein-Barr virus nuclear antigen-1). These cells are human cells that post-translationally modify proteins with human-like structures (e.g. glycans). Such cells are easily transfectable and scalable and are able to grow to high densities in suspension culture. During protein production, 293E cells are grown in serum-free medium to facilitate down-stream purification. Some of the proteins produced comprise additional amino acids encoding one or more detectable labels for purification [e.g. polyhistidine tag, flag tag (DYKDDDDK; SEQ ID NO: 265), etc.] Proteins are N-terminally labeled, C-terminally labeled and/or biotinylated.

Some of the proteins produced comprise additional amino acids encoding one or more 3C protease cleavage site (LEVLFQGP; SEQ ID NO: 266) Such sites allow for cleavage between residues Q and G of the 3C protease cleavage site upon treatment with 3C protease, including with rhinovirus 3C protease. Cleavage sites are introduced to allow for removal of detectable labels from recombinant proteins.

Sequences encoding recombinant proteins of the present invention are cloned into pTT5 vectors (NRC Biotechnology Research Institute, Montreal, Québec.) for transfection into cells. Such vectors are small (~4.4 kb), facilitate transient transfection, comprise a strong CMV promoter for robust protein synthesis and comprise an oriP for episomal replication in EBNA1-expressing cells.

Example 2

Generation of Antibodies

Antibodies Produced by Standard Monoclonal Antibody Generation

Antibodies are generated in knockout mice, lacking the gene that encodes for desired target antigens. Such mice are not tolerized to target antigens and therefore generate antibodies against such antigens that may cross react with human and mouse forms of the antigen. For the production of monoclonal antibodies, host mice are immunized with recombinant proteins to elicit lymphocytes that specifically bind to these proteins. Lymphocytes are collected and fused with immortalized cell lines. The resulting hybridoma cells are cultured in a suitable culture medium with selection agents to support the growth of only fused cells.

Desired hybridoma cell lines are then identified through binding specificity analysis of the secreted antibodies for the target peptide and clones of these cells are subcloned through limiting dilution procedures and grown by standard methods. Antibodies produced by these cells are isolated and purified from the culture medium by standard immunoglobulin purification procedures Antibodies Produced Recombinantly Recombinant antibodies are produced using the hybridoma cells produced above.

Heavy and light chain variable region cDNA sequences of the antibodies are determined using standard biochemical techniques. Total RNA are extracted from antibody-producing hybridoma cells and converted to cDNA by reverse transcriptase (RT) polymerase chain reaction (PCR). PCR amplification is carried out on the resulting cDNA using primers specific for amplification of the heavy and light chain sequences. PCR products are then subcloned into plasmids for sequence analysis. Once sequenced, antibody coding sequences are placed into expression vectors. For humanization, coding sequences for human heavy and light chain constant domains are used to substitute for homologous murine sequences. The resulting constructs are transfected into mammalian cells capable of large scale translation.

Antibodies Produced by Using Antibody Fragment Display Library Screening Techniques Antibodies of the present invention may be produced using high throughput methods of discovery. Synthetic antibodies are designed by screening target antigens using a phage display library. The phage display libraries are composed of millions to billions of phage particles, each expressing a unique Fab antibody fragment or single chain variable fragment (scFv) on their viral coat. In Fab antibody fragment libraries, the cDNA encoding each fragment contains the same sequence with the exception of a unique sequence encoding the variable loops of the complementarity determining regions (CDRs). The $V_H$ chains of the CDR are expressed as a fusion protein, linked to the N-terminus of the viral pIII coat protein. The $V_L$ chain is expressed separately and assembles with the $V_H$ chain in the periplasm prior to incorporation of the complex into the viral coat. Target antigens are incubated, in vitro, with members of phage display libraries and bound phage particles are precipitated. The cDNA encoding the CDRs of the bound Fab subunits is sequenced from the bound phage. The cDNA sequence is directly incorporated into antibody sequences for recombinant antibody production, or mutated and utilized for further optimization through in vitro affinity maturation.

Antibodies Produced Using Affinity Maturation Techniques

Fabs capable of binding target antigens are identified using the libraries described above and high affinity mutants are derived from these through the process of affinity maturation. Affinity maturation technology is used to identify sequences encoding CDRs that have the highest affinity for the target antigen. Using this technology, the CDR sequences isolated using the phage display library selection process described above are mutated randomly as a whole or at specific residues to create a millions to billions of variants. These variants are expressed in Fab antibody fragment fusion proteins in a phage display library and screened for their ability to bind the target antigen. Several rounds of selection, mutation and expression are carried out to identify antibody fragment sequences with the highest affinity for the target antigen. These sequences can be directly incorporated into antibody sequences for recombinant antibody production.

Example 3

Identification and Characterization of Antibodies Directed to Recombinant Proteins Recombinant proteins are synthesized according to the method of Example 1 or obtained from commercial sources. Recombinant proteins expressed include those listed in Table 17.

TABLE 17

| Recombinant proteins | |
|---|---|
| Recombinant Protein | Key Features |
| proTGF-β1 C4S | N-terminal association blocked |
| TGF-β1 LAP C4S | LAP only |
| | N-terminal association blocked |
| proTGF-β1 complexed with LTBP1S | N-terminal association with LTBP1 splice variant |
| TGF-β1 LAP + sGARP | LAP only |
| | N-terminal association with soluble GARP |
| proTGF-β1 sGARP | N-terminal association with soluble GARP |
| proGDF-8 | |
| GDF-8 prodomain | Prodomain only |

Both human and non-human (including, but not limited to mouse) isoforms of the recombinant proteins listed in Table 17 are expressed.

Antibodies are generated according to the methods described in Example 2, which bind to recombinant proteins expressed and are subjected to screening to identify antibodies with desired binding properties. ELISA assays are used initially to identify antibody candidates that demonstrate affinity for desired antigens, while showing reduced or no affinity for undesired antigens.

Identification of Stabilizing Antibodies Directed to the TGF-β1 GPC

Antibodies directed to proTGF-β1 C4S are screened using ELISAs to detect binding to positive and negative selection antigens. Antibodies are assessed overall for their ability to associate with prodomains (with or without ligand) and decrease TGF-β signaling. ELISA plates are coated with neutravidin and incubated with biotinylated proTGF-β1 C4S recombinant proteins. To identify and eliminate antibodies that bind to miscellaneous elements (e.g. polyhistidine tags, flag tags and/or 3C proteinase cleavage sites), coated ELISA plates are incubated with human ICAM-1 proteins comprising one or more of such miscellaneous elements. To identify and eliminate antibodies that bind to free TGF-β1 growth factor and/or LAP, coated ELISA plates are incubated with human TGF-β1 LAP C4S and/or TGF-β1 growth factor. Antibodies that may be specific for murine versions are identified by incubating coated ELISA plates with biotinylated mu proTGF-β1 C4S. Recombinant proteins that associate with antibodies bound on ELISA plates are detected using secondary antibodies conjugated with enzymes for detection (e.g. colorimetric, fluorimetric) that bind to detectable labels present on bound recombinant proteins. Antibodies are selected for additional rounds of selection or eliminated from testing pools based on results obtained.

Antibodies directed to proTGF-β1 C4S are further assessed for their ability to stabilize TGF-β1 GPCs. Cells expressing GPCs and/or $\alpha v \beta_6$ integrin are incubated with selected antibodies and resulting supernatants are used to treat cultures of cells comprising TGF-β-responsive reporter constructs to detect free growth factor-dependent gene expression activity. Additional assays are carried out to characterize regions of antibody recognition bound by selected antibodies as well as growth factor modulation in specific cell types (e.g. fibroblasts and/or T-cells). Finally, affinity binding estimates are made using cross blocking experiments to bin antibodies as well as through the use of affinity analysis instruments, including, but not limited to Octet® (ForteBio, Menlo Park, Calif.) family instruments. Antibodies are further selected based on their ability to stabilize alternative TGF-β GPC isoforms (e.g. TGF-β1, TGF-β2 and/or TGF-β3) and TGF-β1 GPCs from other species.

Identification of Releasing Antibodies Directed to Free TGF-β1 LAP

According to one mode for the generation of TGF-β1 GPC releasing antibodies, antibodies directed to proTGF-β1 LAP C4S are screened using ELISAs to detect binding to positive and negative selection antigens. Antibodies are assessed overall for their ability to associate with LAP and increase TGF-β1 free growth factor levels and/or signaling. ELISA plates are coated with neutravidin and incubated with biotinylated proTGF-β1 LAP C4S recombinant proteins. To identify and eliminate antibodies that bind to miscellaneous elements (e.g. polyhistidine tags, flag tags and/or 3C proteinase cleavage sites), coated ELISA plates are incubated with human ICAM-1 proteins comprising one or more of such miscellaneous elements. To identify and eliminate antibodies that bind to free TGF-β1 growth factor, coated ELISA plates are incubated with human TGF-β1 growth factor. To identify and eliminate antibodies that bind to latent TGF-β1, coated ELISA plates are incubated with human TGF-β1 C4S. Antibodies that may be specific for murine versions are identified by incubating coated ELISA plates with biotinylated muTGF-β1 LAP C4S. Recombinant proteins that associate with antibodies bound on ELISA plates are detected using secondary antibodies conjugated with enzymes for detection (e.g. colorimetric, fluorimetric) that bind to detectable labels present on bound recombinant proteins. Antibodies are selected for additional rounds of selection or eliminated from testing pools based on results obtained.

Antibodies directed to proTGF-β1 LAP C4S are further assessed for their ability to release TGF-β1 from GPCs. Cells expressing GPCs and/or $\alpha v\beta_6$ integrin are incubated with selected antibodies and resulting supernatants are used to treat cultures of cells comprising TGF-β-responsive reporter constructs to detect free growth factor-dependent gene expression activity. Additional assays are carried out to characterize regions of antibody recognition bound by selected antibodies as well as growth factor modulation in specific cell types (e.g. fibroblasts and/or T-cells). Finally, affinity binding estimates are made using cross blocking experiments to bin antibodies as well as through the use of affinity analysis instruments, including, but not limited to Octet® (ForteBio, Menlo Park, Calif.) family instruments. Antibodies are further selected based on their ability to elevate free growth factor relative to latent growth factor with alternative TGF-β GPC isoforms (e.g. TGF-β1, TGF-β2 and/or TGF-β3) and TGF-β1 GPCs from other species.

Identification of Stabilizing Antibodies Directed to the TGF-β1 GPC in the Context of LTBP Antibodies directed to proTGF-β1 complexed with LTBP are screened using ELISAs to detect binding to positive and negative selection antigens. Antibodies are assessed overall for their ability to associate with prodomains and decrease TGF-β signaling. ELISA plates are coated with neutravidin and incubated with biotinylated proTGF-β1 complexed with LTBP antibody pools and incubated with recombinant proteins comprising one or more detectable labels. To identify and eliminate antibodies that bind to miscellaneous elements (e.g. polyhistidine tags, flag tags and/or 3C proteinase cleavage sites), coated ELISA plates are incubated with human ICAM-1 proteins comprising one or more of such miscellaneous elements. To identify and eliminate antibodies that bind to free TGF-β1, coated ELISA plates are incubated with human TGF-β1 growth factor. Antibodies that may be specific for murine versions are identified by incubating coated ELISA plates with muproTGF-β1 complexed with LTBP1S. Recombinant proteins that associate with antibodies bound on ELISA plates are detected using secondary antibodies conjugated with enzymes for detection (e.g. colorimetric, fluorimetric) that bind to detectable labels present on bound recombinant proteins. Antibodies are selected for additional rounds of selection or eliminated from testing pools based on results obtained.

Antibodies directed to proTGF-β1 complexed with LTBP are further assessed for their ability to stabilize TGF-β1 GPCs against activation by $\alpha v\beta_6$ expressed on cells. Cells expressing GPCs and/or $\alpha v\beta_6$ integrin are incubated with selected antibodies and resulting supernatants are used to treat cultures of cells comprising TGF-β-responsive reporter constructs to detect free growth factor-dependent gene expression activity. Additional assays are carried out to characterize regions of antibody recognition bound by selected antibodies as well as growth factor modulation in specific cell types (e.g. fibroblasts and/or T-cells). Finally, affinity binding estimates are made using cross blocking experiments to bin antibodies as well as through the use of affinity analysis instruments, including, but not limited to Octet® (ForteBio, Menlo Park, Calif.) family instruments. Antibodies are further selected based on their ability to stabilize alternative TGF-β GPC isoforms (e.g. TGF-β1, TGF-β2 and/or TGF-β3) and TGF-β1 GPCs from other species.

Identification of Releasing Antibodies Directed to TGF-β1 LAP in the Context of GARP Antibodies directed to TGF-β1 LAP complexed with sGARP are screened using ELISAs to detect binding to positive and negative selection antigens. Antibodies are assessed overall for their ability to associate with LAP, but not with free GARP and for their ability to increase TGF-β1 free growth factor levels and/or signaling. ELISA plates are coated neutravidin followed by incubation with biotinylated TGF-β1 LAP complexed with sGARP antibody pools and incubated with recombinant proteins comprising one or more detectable labels. To identify and eliminate antibodies that bind to miscellaneous elements (e.g. polyhistidine tags, flag tags and/or 3C proteinase cleavage sites), coated ELISA plates are incubated with human ICAM-1 proteins comprising one or more of such miscellaneous elements. To identify and eliminate antibodies that bind to free GARP, coated ELISA plates are incubated with sGARP. Antibodies that may be specific for murine versions are identified by incubating coated ELISA plates with muTGF-β1 LAP complexed with sGARP. Recombinant proteins that associate with antibodies bound on ELISA plates are detected using secondary antibodies conjugated with enzymes for detection (e.g. colorimetric, fluorimetric) that bind to detectable labels present on bound recombinant proteins. Antibodies are selected for additional rounds of selection or eliminated from testing pools based on results obtained.

Antibodies directed to TGF-β1 LAP complexed with sGARP are further assessed for their ability to release TGF-β1 from GPCs. Cells expressing GPCs and/or $\alpha v\beta_6$ integrin are incubated with selected antibodies and resulting supernatants are used to treat cultures of cells comprising TGF-β- responsive reporter constructs to detect free growth factor-dependent gene expression activity.

Antibodies are also tested for the ability to activate T-cell specific TGF-β-dependent gene expression. FoxP3 is a transcription factor expressed in T-cells, known to be immunomodulatory. It is known to be regulated by TGF-β associated with T-cell surface GARP. Cells expressing GPCs as well as GARP are incubated with selected antibodies and resulting supernatants are used to treat cultures of EL4 cells comprising FoxP3 reporter constructs.

Additional assays are carried out to characterize regions of antibody recognition bound by selected antibodies as well as growth factor modulation in specific cell types (e.g. fibroblasts and/or T-cells). Finally, affinity binding estimates are made using cross blocking experiments to bin antibodies as well as through the use of affinity analysis instruments, including, but not limited to Octet® (ForteBio, Menlo Park, Calif.) family instruments. Antibodies are further selected based on their ability to elevate free growth factor relative to latent growth factor with alternative TGF-β GPC isoforms (e.g. TGF-β1, TGF-β2 and/or TGF-β3) and TGF-β1 GPCs from other species.

Identification of Stabilizing Antibodies Directed to the TGF-β1 GPC in the Context of GARP Antibodies directed to proTGF-β1 complexed with sGARP are screened using ELISAs to detect binding to positive and negative selection antigens. Antibodies are assessed overall for their ability to associate with prodomains and decrease TGF-β signaling. ELISA plates are coated neutravidin, followed by incubation with biotinylated proTGF-β1 complexed with sGARP antibody pools and incubated with recombinant proteins comprising one or more detectable labels. To identify and eliminate antibodies that bind to miscellaneous elements (e.g. polyhistidine tags, flag tags and/or 3C proteinase cleavage sites), coated ELISA plates are incubated with human ICAM-1 proteins comprising one or more of such miscellaneous elements. To identify and eliminate antibodies that bind to free GARP, coated ELISA plates are incubated with human sGARP. Antibodies that may be specific for murine versions are identified by incubating coated ELISA plates with muproTGF-β1 complexed with sGARP. Recombinant proteins that associate with antibodies bound on ELISA plates are detected using secondary antibodies conjugated with enzymes for colorimetric detection (e.g. horseradish peroxidase) that bind to detectable labels present on bound recombinant proteins. Antibodies are selected for additional rounds of selection or eliminated from testing pools based on results obtained.

Antibodies directed to proTGF-β1 complexed with sGARP are further assessed for their ability to stabilize TGF-β1 GPCs. Cells expressing GPCs are incubated with selected antibodies and resulting supernatants are used to treat cultures of cells comprising TGF-β-responsive reporter constructs to detect free growth factor-dependent gene expression activity.

Antibodies are also tested for the ability to reduce T-cell specific TGF-β-dependent gene expression. Cells expressing GPCs as well as GARP are incubated with selected antibodies and resulting supernatants are used to treat cultures of EL4 cells comprising FoxP3 reporter constructs. Additional assays are carried out to characterize regions of antibody recognition bound by selected antibodies as well as growth factor modulation in specific cell types (e.g. fibroblasts and/or T-cells). Finally, affinity binding estimates are made using cross blocking experiments to bin antibodies as well as through the use of affinity analysis instruments, including, but not limited to Octet® (ForteBio, Menlo Park, Calif.) family instruments. Antibodies are further selected based on their ability to stabilize alternative TGF-β GPC isoforms (e.g. TGF-β1, TGF-β2 and/or TGF-β3) and TGF-β1 GPCs from other species.

Example 4

Chimeric Protein Design Using Sequence Alignments

For chimeric protein design, the alignment of TGF-β family members was constructed to identify conserved structural features and the degree of conservation of these features (FIGS. 8A-8G.) Comparison between N-terminal region sequences revealed higher levels of conservation among N-terminal regions of the prodomain. Based on this sequence alignment and structural features of these protein modules, a generic chimeric design strategy for TGF-β family members was adopted, such that chimeras were designed where the ARM domains are swapped (either the entire ARM domain, or subsets of the ARM domain as indicated) among family members.

Specifically, for the generation of chimeras comprising protein modules of TGF-β1, TGF-β2 and/or TGF-β3, alignment of the three was carried out using standard approaches, and these sequence alignments were used to create a homology model comparing TGF-β2 and TGF-β3 to the crystal structure of porcine TGF-β1 (Shi, M. et al., Latent TGF-beta structure and activation. Nature. 2011 Jun. 15; 474(7351): 343-9.) Briefly, the sequence of TGF-β2 or TGF-β3 was modeled based on the template structure and sequence alignment along with the satisfaction of standard spatial restraints using standard procedures. These three dimensional models were analyzed to visualize how proposed chimeric combinations may comprise areas of steric clash. As used herein, the term "steric clash" refers to an interaction between two or more entities and/or moieties that is disruptive to the shape and/or conformation of each entity, each moiety or an entity comprising the two or more moieties participating in the interaction. Three dimensional modeling revealed possible steric clashes between the latency loop of TGF-β2 and the mature growth factor of TGF-β1. Specifically, the TGF-β2 latency loop comprises a D-Y-P amino acid sequence, the side chains of which may overlap with regions of the TGF-β1 growth factor.

Example 5

TGF-β1 Chimeric Protein with TGF-β2 Trigger Loop

The activation mechanism for TGF-β2 remains to be fully understood. Activation may be dependent upon one or more associations between the TGF-β2 trigger loop and $\alpha_9\beta_1$ integrin. To assess this mechanism of TGF-β2 activity, chimeric proteins are synthesized comprising GPCs comprising TGF-β1 wherein protein modules comprising the sequence SGRRGDLATI (SEQ ID NO:242) are substituted with protein modules comprising TGF-β2 trigger loops comprising the sequence GTSTYTSGDQKTIKSTRKK (SEQ ID NO:180) The activation mechanism of these chimeric proteins (TGF-$\beta1^{Trigger\ Loop\ (short)\ \beta2}$ chimeric proteins) is tested by cell based assay. Cells (HEK293 or Sw-480 cells) are transfected with or without $\alpha_9\beta_1$ integrin in addition to either GPCs comprising TGF-β2, GPCs comprising TGF-$\beta1^{Trigger\ Loop\ (short)\ \beta2}$ and/or GPCs comprising mutant TGF-β2 (as non-active controls) wherein trigger loops comprise the mutations Y240A, D245A and/or Q246A. Reporter cell lines are used to detect growth factor release.

Example 6

Assessment of α$_9$β$_1$-TGF-β2 Binding and Growth Factor Release

Binding between α$_9$β$_1$ and TGF-β2 as well as subsequent growth factor release is not well understood in the art. If the residues involved in this association can be elucidated, antibodies designed to disrupt α$_9$β$_1$-TGF-β2 association may be developed and used to specifically target TGF-β2 growth factor release.

Mutant constructs as well as chimeras comprising altered forms of TGF-β2 are tested by activation assay so that the α$_9$β$_1$ binding site on TGF-β2 may be mapped. This is done by generating TGF-β1/TGF-β2 chimeras with deletion and/or mutation of amino acid residues in or around the trigger loop (in some embodiments, comprising the amino acid sequence FAGIDGTSTYTSGDQKTIKSTRKKNSGKTP; SEQ ID NO: 65) or with residue-specific mutations to alanine. In some cases, TGF-β1 or TGF-β3 may or may not serve as negative controls for $\alpha_9\beta_1$ binding. In some embodiments, recombinant proteins used for $\alpha_9\beta_1$ binding site mapping may include those listed in Table 18. These include proTGF-β2-M1, proTGF-β2-M2, proTGF-β2-M3, proTGF-β2-M4 and proTGF-β2-M5 comprising amino acid deletions within the trigger loop. Also included is proTGF-β2-M6 comprising mutation of two residues, Ile-Asp, to Phe-Thr. Finally, a chimeric protein is included which comprises TGF-β2 wherein a portion of the trigger loop has been substituted with a portion of the trigger loop from TGF-β1.

TABLE 18

Recombinant protein for α9β1 binding site mapping

| Recombinant Protein | Key Features | SEQ ID NO |
|---|---|---|
| TGF-β2 | SLSTCSTLDMDQFMRKRIEAIRGQILSKLKLTSP<br>PEDYPEPEEVPPEVISIYNSTRDLLQEKASRRAA<br>ACERERSDEEYYAKEVYKIDMPPFFPSENAIPPT<br>FYRPYFRIVRFDVSAMEKNASNLVKAEFRVFRLQ<br>NPKARVPEQRIELYQILKSKDLTSPTQRYIDSKV<br>VKTRAEGEWLSFDVTDAVHEWLHHKDRNLGFKIS<br>LHCPCCTFVPSNNYIIPNKSEELEARFAGIDGTS<br>TYTSGDQKTIKSTRKKNSGKTPHLLLMLLPSYRL<br>ESQQTNRRKKRALDAAYCFRNVQDNCCLRPLYID<br>FKRDLGWKWIHEPKGYNANFCAGACPYLWSSDTQ<br>HSRVLSLYNTINPEASASPCCVSQDLEPLTILYY<br>IGKTPKIEQLSNMIVKSCKCS | 2 |
| proTGF-β2-M1 | SLSTCSTLDMDQFMRKRIEAIRGQILSKLKLTSP<br>PEDYPEPEEVPPEVISIYNSTRDLLQEKASRRAA<br>ACERERSDEEYYAKEVYKIDMPPFFPSENAIPPT<br>FYRPYFRIVRFDVSAMEKNASNLVKAEFRVFRLQ<br>NPKARVPEQRIELYQILKSKDLTSPTQRYIDSKV<br>VKTRAEGEWLSFDVTDAVHEWLHHKDRNLGFKIS<br>LHCPCCTFVPSNNYIIPNKSEELEARFYTSGDQK<br>TIKSTRKKNSGKTPHLLLMLLPSYRLESQQTNRR<br>KKRALDAAYCFRNVQDNCCLRPLYIDFKRDLGWK<br>WIHEPKGYNANFCAGACPYLWSSDTQHSRVLSLY<br>NTINPEASASPCCVSQDLEPLTILYYIGKTPKIE<br>QLSNMIVKSCKCS | 267 |
| proTGF-β2-M2 | SLSTCSTLDMDQFMRKRIEAIRGQILSKLKLTSP<br>PEDYPEPEEVPPEVISIYNSTRDLLQEKASRRAA<br>ACERERSDEEYYAKEVYKIDMPPFFPSENAIPPT<br>FYRPYFRIVRFDVSAMEKNASNLVKAEFRVFRLQ<br>NPKARVPEQRIELYQILKSKDLTSPTQRYIDSKV<br>VKTRAEGEWLSFDVTDAVHEWLHHKDRNLGFKIS<br>LHCPCCTFVPSNNYIIPNKSEELEARFAGIDGTS<br>TIKSTRKKNSGKTPHLLLMLLPSYRLESQQTNRR<br>KKRALDAAYCFRNVQDNCCLRPLYIDFKRDLGWK<br>WIHEPKGYNANFCAGACPYLWSSDTQHSRVLSLY<br>NTINPEASASPCCVSQDLEPLTILYYIGKTPKIE<br>QLSNMIVKSCKCS | 268 |
| proTGF-β2-M3 | SLSTCSTLDMDQFMRKRIEAIRGQILSKLKLTSP<br>PEDYPEPEEVPPEVISIYNSTRDLLQEKASRRAA<br>ACERERSDEEYYAKEVYKIDMPPFFPSENAIPPT<br>FYRPYFRIVRFDVSAMEKNASNLVKAEFRVFRLQ<br>NPKARVPEQRIELYQILKSKDLTSPTQRYIDSKV<br>VKTRAEGEWLSFDVTDAVHEWLHHKDRNLGFKIS<br>LHCPCCTFVPSNNYIIPNKSEELEARFAGIDGTS<br>TYTSGDQKTSGKTPHLLLMLLPSYRLESQQTNRR<br>KKRALDAAYCFRNVQDNCCLRPLYIDFKRDLGWK<br>WIHEPKGYNANFCAGACPYLWSSDTQHSRVLSLY<br>NTINPEASASPCCVSQDLEPLTILYYIGKTPKIE<br>QLSNMIVKSCKCS | 269 |
| proTGF-β2-M4 | SLSTCSTLDMDQFMRKRIEAIRGQILSKLKLTSP<br>PEDYPEPEEVPPEVISIYNSTRDLLQEKASRRAA<br>ACERERSDEEYYAKEVYKIDMPPFFPSENAIPPT<br>FYRPYFRIVRFDVSAMEKNASNLVKAEFRVFRLQ<br>NPKARVPEQRIELYQILKSKDLTSPTQRYIDSKV<br>VKTRAEGEWLSFDVTDAVHEWLHHKDRNLGFKIS<br>LHCPCCTFVPSNNYIIPNKSEELEARFAGIDGTS<br>TYTSGDQKTIKSTRKKNPHLLLMLLPSYRLESQQ<br>TNRRKKRALDAAYCFRNVQDNCCLRPLYIDFKRD<br>LGWKWIHEPKGYNANFCAGACPYLWSSDTQHSRV<br>LSLYNTINPEASASPCCVSQDLEPLTILYYIGKT<br>PKIEQLSNMIVKSCKCS | 270 |
| proTGF-β2-M5 | SLSTCSTLDMDQFMRKRIEAIRGQILSKLKLTSP<br>PEDYPEPEEVPPEVISIYNSTRDLLQEKASRRAA<br>ACERERSDEEYYAKEVYKIDMPPFFPSENAIPPT<br>FYRPYFRIVRFDVSAMEKNASNLVKAEFRVFRLQ<br>NPKARVPEQRIELYQILKSKDLTSPTQRYIDSKV<br>VKTRAEGEWLSFDVTDAVHEWLHHKDRNLGFKIS<br>LHCPCCTFVPSNNYIIPNKSEELEARFGTSTYTS<br>GDQKTIKSTRKKNSGKTPHLLLMLLPSYRLESQQ<br>TNRRKKRALDAAYCFRNVQDNCCLRPLYIDFKRD<br>LGWKWIHEPKGYNANFCAGACPYLWSSDTQHSRV<br>LSLYNTINPEASASPCCVSQDLEPLTILYYIGKT<br>PKIEQLSNMIVKSCKCS | 271 |
| proTGF-β2-M6 | SLSTCSTLDMDQFMRKRIEAIRGQILSKLKLTSP<br>PEDYPEPEEVPPEVISIYNSTRDLLQEKASRRAA<br>ACERERSDEEYYAKEVYKIDMPPFFPSENAIPPT<br>FYRPYFRIVRFDVSAMEKNASNLVKAEFRVFRLQ<br>NPKARVPEQRIELYQILKSKDLTSPTQRYIDSKV<br>VKTRAEGEWLSFDVTDAVHEWLHHKDRNLGFKIS<br>LHCPCCTFVPSNNYIIPNKSEELEARFAGFTGTS<br>TYTSGDQKTIKSTRKKNSGKTPHLLLMLLPSYRL<br>ESQQTNRRKKRALDAAYCFRNVQDNCCLRPLYID<br>FKRDLGWKWIHEPKGYNANFCAGACPYLWSSDTQ<br>HSRVLSLYNTINPEASASPCCVSQDLEPLTILYY<br>IGKTPKIEQLSNMIVKSCKCS | 272 |
| proTGF-$\beta2^{RGD\beta1}$ | SLSTCSTLDMDQFMRKRIEAIRGQILSKLKLTSP<br>PEDYPEPEEVPPEVISIYNSTRDLLQEKASRRAA<br>ACERERSDEEYYAKEVYKIDMPPFFPSENAIPPT<br>FYRPYFRIVRFDVSAMEKNASNLVKAEFRVFRLQ<br>NPKARVPEQRIELYQILKSKDLTSPTQRYIDSKV<br>VKTRAEGEWLSFDVTDAVHEWLHHKDRNLGFKIS<br>LHCPCCTFVPSNNYIIPNKSEELEARFAGIDTGR<br>RGDLATINSGKTPHLLLMLLPSYRLESQQTNRRK<br>KRALDAAYCFRNVQDNCCLRPLYIDFKRDLGWKW<br>IHEPKGYNANFCAGACPYLWSSDTQHSRVLSLYN<br>TINPEASASPCCVSQDLEPLTILYYIGKTPKIEQ<br>LSNMIVKSCKCS | 273 |

The activation mechanism of these recombinant proteins is tested by cell based assay. Cells (HEK293 or Sw-480 cells)

are transfected with or without $\alpha_9\beta_1$ integrin in addition to either GPCs comprising TGF-β2, GPCs comprising alanine substitution mutations for each residue in the trigger loop (wherein each GPC tested comprises a single substitution,) one of the recombinant proteins listed in Table 18 and/or GPCs comprising inactive mutants of TGF-β2 (as non-active controls). Reporter cell lines are used to detect growth factor release in media samples taken from the transfected cells. Results are used to determine which residues within the trigger loop are necessary for $\alpha_9\beta_1$-dependent TGF-β2 growth factor release.

Example 7

Sequence Alignment

A multiple sequence alignment of TGF-β family members was adapted from Shi et. al. 2011 (Shi, M. et al., Latent TGF-beta structure and activation. Nature. 2011 Jun. 15; 474(7351):343-9.) The sequences of human TGF-β1, TGF-β2, TGF-β3, GDF-11, Inhibin Beta A, Inhibin Alpha A, BMP9, BMP2, BMP4, BMP7, BMP6, BMP8A, Leftyl, and murine TGF-β1, GDF11, GDF8 and cynomolgous monkey TGF-β1, and GDF8 were added to the alignment using standard methods, and the sequences included the full-length proteins (excluding signal peptide sequences) (FIGS. 8A-8G.)

Example 8

Myostatin Proliferation Assay $C_2C_{12}$ murine myoblasts (ATCC, Manassas, Va.) are cultured in Dulbecco's modified essential medium (DMEM; Life Technologies, Carlsbad, Calif.) with 10% fetal bovine serum (FBS; Life Technologies, Carlsbad, Calif.) prior to carrying out the assay. The percentage of FBS is varied and/or replaced with bovine serum albumin (BSA) at varying concentrations. Cell proliferation assays are conducted in uncoated 96-well plates. $C_2C_{12}$ cultures are seeded at 1000 cells per well. After allowing the cells to attach for 16 hours, myostatin test media is added. Recombinant human myostatin (R&D Systems, Minneapolis, Minn.) is used for standard curve generation. For experimental systems, the supernatant from 293E cells overexpressing myostatin is added, following treatment with experimental antibodies. All samples are run in replicates of 8. Plates are incubated for 72 hours in an atmosphere of 37° C. and 5% CO2. Proliferation is assessed using a CellTiter-Glo® Luminescent Cell Viability Assay (Promega BioSciences, LLC, Madison, Wis.) whereby cell lysis generates a luminescent signal proportional to the amount of ATP present, which is directly proportional to the number of cells present in culture (Thomas, M. et al., Myostatin, a negative regulator of muscle growth, functions by inhibiting myoblast proliferation. 2000. 275(51):40235-43.)

Example 9

GPC Immobilization by Biotinylation and Detection of Integrin-Mediated Growth Factor Release Recombinant GPCs of the present invention are N-terminally biotinylated and incubated on streptavidin/avidin-coated culture surfaces. Cells expressing various integrins are added to the cell culture surfaces and cultured for 24 hours. Media are removed and added to growth factor reporter cell cultures that express luciferase in response to growth factor activity. After 24 hours, cells are washed, lysed and analyzed for luciferase activity.

Example 10

Protein Purification by Ni-NTA

Cells (293-6E cells) expressing His-tagged proteins are cultured in serum-free medium (FreeStyle F17 medium, Life Technologies, Carlsbad, Calif.) supplemented with 4 mM glutamine, 0.1% Pluronic F68 and 25 μg/ml G418. Once their viability drops below 50%, tissue culture supernatant is collected and cleared by centrifugation for 10 minutes at 200× gravity at 4° C. Supernatant is then filtered by passing it through a 0.22 or 0.45 μm pore filter. Filtered supernatant is combined with Tris, NaCl and $NiCl_2$ for a final concentration of 50 mM Tris pH 8.0, 500 mM NaCl and 0.5 mM $NiCl_2$. 1 ml of the adjusted solution is collected for later analysis by SDS-poly acrylamide gel electrophoresis (PAGE) or Western blot, while another portion of the adjusted solution is combined with washed Ni-NTA resin (Life Technologies, Carlsbad, Calif.) at a concentration of 5-10 ml of Ni-NTA resin per 300 ml of the adjusted solution. This combined solution is then stirred at 4° C. using a suspended magnetic stir bar (to prevent grinding of Ni-NTA agarose.) Ni-NTA resin is next collected by centrifugation at 200× gravity at 4° C. for 10 minutes.

Next, the column is washed with 15 column volumes (CV) of wash buffer (20 mM Tris, pH 8.0, 500 mM NaCl and 20 mM imidazole.) An aliquot of the last wash is collected for analysis. The column is then eluted with 3 CV of elution buffer (20 mM Tris, pH 8.0, 500 mM NaCl and 300 mM imidazole) and ⅓ column volume fractions are collected for analysis.

The absorbance at 280 nm is measured in each of the eluted fractions collected and compared to the absorbance at 280 nm of blank elution buffer. Earlier fractions typically have negative absorption due to the imidazole gradient; however, fractions containing higher amounts of protein have positive values. Collected fractions are then run on SDS-PAGE for analysis and relevant fractions are pooled for further purification.

Example 11

Design of GDF-8/GDF-11/Activin Chimeras

The structure-based alignment of TGF-β family members was used to construct three-dimensional models of potential chimeric proteins comprising combinations of modules from GDF-8 and GDF-11 using the Schrodinger Bioluminate software. A chimeric model of GDF-8 comprising an arm region of GDF-11 (SEQ ID NO:216) revealed a region of potential steric clash involving GDF-11 residue F95. According to the model, F95 from the GDF-11 arm causes destabilization of the α2 helix of the chimeric GPC. Therefore, GDF8/GDF11/Activin chimeras were designed so that the ARM region of the chimera contains the α2 helix.

Example 12

ELISA Analysis

Enzyme-linked immunosorbent assay (ELISA) analysis is carried out to assess antibody binding. 96-well ELISA assay plates are coated with neutravidin, a deglycosylated version of streptavidin with a more neutral pI. Target proteins are expressed with or without histidine (His) tags and subjected to biotinylation. Biotinylated target proteins are incubated with neutravidin-coated ELISA assay plates for two hours at room temperature and unbound proteins are removed by washing three times with wash buffer (25 mM Tris, 150 mM NaCl, 0.1% BSA, 0.05% TWEEN®-20.) Primary antibodies being tested are added to each well and allowed to incubate at room temperature for 1 hour or more. Unbound antibody is then removed by washing three times with wash buffer. Secondary antibodies capable of binding to primary antibodies being tested and conjugated with detectable labels are then incubated in each well for 30 minutes at room temperature. Unbound secondary antibodies are removed by washing three times with wash buffer. Finally, bound secondary antibodies are detected by enzymatic reaction, fluorescence detection and/or luminescence detection, depending on the detectable label present on secondary antibodies being detected.

Example 13

Identification of Antibodies Using Phage Selection

Screening programs are conducted to generate antibody panels that bind target antigens. Antibody panel diversity is measured by epitope diversity as opposed to diversity of antibody sequences. Both solid-phase phage enrichment strategies as well as solution-phase enrichment strategies are employed.

Target antigens (both for solid-phase and solution phase enrichment) are subjected to biophysical characterization prior to use, including reducing and non-reducing SDS-PAGE to establish purity and size exclusion chromatography (SEC) to establish acceptable aggregation levels. Additionally, functional assays are carried out to verify target antigen bioactivity.

2-3 rounds of enrichment are carried out with the expectation that only three rounds will be necessary. Aliquots of phage from selection rounds 2-4 are preserved for later use. After enrichment, randomly selected clones are screened by ELISA to examine binding to target antigens as well as non-target antigens. Based on these analyses, up to 500 clones are selected for nucleotide sequencing and analysis of the number of distinct antibodies as well as the frequency of isolation and number of distinct $V_H$ and $V_L$ regions. Based on these subsequent analyses, up to 100 clones are selected for epitope binning by epitope-relatedness using surface plasmon resonance technology (or equivalent approach.) Dissociation constants ($k_{off}$) for each are determined and up to 50 clones are selected for further characterization.

Final candidates are expressed as bivalent antibody constructs, purified and $k_{off}$ for each are determined. Cell-based functional assays are used to characterize purified bivalent antibodies.

Example 14

Identification of Antibodies that Block Activation of proGDF-8

Production of a diverse panel of antibodies is carried out to identify antibodies that bind proGDF-8 and block release of mature growth factor. Antibody generation is carried out according to the methods of Example 12 wherein recombinant proGDF-8 is used for solid-phase enrichment and biotinylated proGDF-8 is used for solution-phase enrichment. Antigen preparations are tested for aggregation levels to ensure that >95% are dimeric species. In ELISA analysis of enriched clones, binding to six antigens is assessed (proGDF-8, GDF-8 prodomain, GDF-8 growth factor, murine proGDF-8, proGDF-11 and proTGF-β1 C4S.) Clones selected based on ELISA analysis are sequenced and antibodies are developed according to the methods of Example 12.

Example 15

Identification of Antibodies that Activate the Release of GDF-11 Growth Factor from the Latent GPC Production of a diverse panel of antibodies is carried out to identify antibodies that bind the prodomain of GDF-11 and activate the release of mature growth factor. Antibody generation is carried out according to the methods of Example 12 wherein recombinant GDF-11 prodomain is used for solid-phase enrichment and biotinylated GDF-11 prodomain is used for solution-phase enrichment. Antigen preparations are tested for aggregation levels to ensure that >95% are monomeric species. In ELISA analysis of enriched clones, binding to six antigens is assessed (GDF-11 prodomain, proGDF-11, GDF-11 growth factor, GDF-8 prodomain, murine GDF-11 prodomain and proTGF-β1 C4S.) Clones selected based on ELISA analysis are sequenced and antibodies are developed according to the methods of Example 12.

Example 16

Identification of Antibodies that Activate the Release of TGF-β1 from the proTGF-β1/GARP Complex Production of a diverse panel of antibodies is carried out to identify antibodies that bind TGF-β1 LAP that is complexed with sGARP (TGF-β1 LAP-sGARP) and activate the release of mature growth factor. Antibody generation is carried out according to the methods of Example 12 wherein recombinant biotinylated TGF-β1 LAP-sGARP is used for solid-phase enrichment and biotinylated TGF-β1 LAP-sGARP is used for solution-phase enrichment. Antigen preparations are tested for aggregation levels to ensure that >95% of the species comprise dimeric TGF-β1 LAP complexed with monomeric sGARP. In ELISA analysis of enriched clones, binding to eight antigens is assessed (TGF-β1 LAP-sGARP, proTGFb1-sGARP, sGARP, TGF-β1 LAP C4S, proTGF-β1 C4S, LTBP1-proTGFb1, ICAM-1 N-His, ICAM-1 C-His.) Clones selected based on ELISA analysis are sequenced and antibodies are developed according to the methods of Example 12.

Example 17

Identification of Antibodies that Block the Release of Mature Growth Factor from the proTGF-β1/GARP Complex Production of a diverse panel of antibodies is carried out to identify antibodies that bind to the complex formed by proTGF-β1 and GARP (proTGF-β1-GARP) and inhibit release of mature growth factor. Antibody generation is carried out according to the methods of Example 12 wherein recombinant biotinylated proTGF-β1-sGARP is used for solid-phase enrichment and biotinylated proTGF-β1-GARP is used for solution-phase enrichment. Antigen preparations are tested for aggregation levels to ensure that >95% of the species comprise dimeric proTGF-β1 complexed with monomeric sGARP. In ELISA analysis of enriched clones, binding to eight antigens is assessed (proTGF-β1-GARP, TGF-β1 LAP, proTGF-β1 C4S, proTGF-β1/LTBP1S complex, TGF-β1 LAP-sGARP, sGARP, ICAM-1 C-His, ICAM-1 N-His.) Clones selected based on ELISA analysis are sequenced and antibodies are developed according to the methods of Example 12.

Example 18

Identification of Antibodies that Block the Release of TGF-β1 from proTGF-β1 Complexed with LTBP1S Production of a diverse panel of antibodies is carried out to identify antibodies that bind proTGF-β1 complexed with LTBP1S (proTGF-β1-LTBP1S) and inhibit release of mature growth factor. Antibody generation is carried out according to the methods of Example 12 wherein recombinant proTGF-β1-LTBP1S is used for solid-phase enrichment and biotinylated proTGF-β1-LTBP1S is used for solution-phase enrichment. Antigen preparations are tested for aggregation levels to ensure that >95% of the species comprise dimeric proTGF-β1 complexed with monomeric LTBP1S. In ELISA analysis of enriched clones, binding to eight antigens is assessed (proTGF-β1-LTBP1S, TGF-β1 LAP, TGF-β1 growth factor, proTGF-β1 C4S, murine proTGF-β1-LTBP1S, LTBP1S, GDF-8 prodomain and proTGF-β2.) Clones selected based on ELISA analysis are sequenced and antibodies are developed according to the methods of Example 12.

Example 19

Identification of Pan-Specific Antibodies that Block the Release of TGF-β1 from proTGF-β1

Production of a diverse panel of antibodies is carried out to identify antibodies that bind proTGF-β1 and inhibit the release of mature growth factor. Antibody generation is carried out according to the methods of Example 12 wherein recombinant proTGF-β1 is used for solid-phase enrichment and biotinylated proTGF-β1 is used for solution-phase enrichment. Antigen preparations are tested for aggregation levels to ensure that >95% are dimeric species. In ELISA analysis of enriched clones, binding to seven antigens is assessed (TGF-β1 LAP, TGF-β1 growth factor, proTGF-β1 C4S, murine proTGF-β1 C4S, GDF-8 prodomain and proTGF-β2.) Clones selected based on ELISA analysis are sequenced and antibodies are developed according to the methods of Example 12.

Example 20

Identification of Pan-Specific Antibodies that Activate the Release of TGF-β1 from proTGF-β1

Production of a diverse panel of antibodies is carried out to identify antibodies that bind TGF-β1 LAP and activate the release of mature growth factor. Antibody generation is carried out according to the methods of Example 12 wherein recombinant TGF-β1 LAP C4S is used for solid-phase enrichment and biotinylated TGF-β1 LAP C4S is used for solution-phase enrichment. Antigen preparations are tested for aggregation levels to ensure that >95% are dimeric species. In ELISA analysis of enriched clones, binding to seven antigens is assessed (TGF-β1 LAP C4S, proTGF-β1 C4S, murine proTGF-β1 C4S, TGF-β1 mature growth factor, proGDF-8 and proTGF-β2.) Clones selected based on ELISA analysis are sequenced and antibodies are developed according to the methods of Example 12.

Example 21

Immunization of TGF-β1 Knockout Mice

Neonatal mice are immunized according to the methods of Oida et al (Oida, T. et al., TGF-β induces surface LAP expression on Murine CD4 T cells independent of FoxP3 induction. PLOS One. 2010. 5(11):e15523, the contents of which are herein incorporated by reference in their entirety.) TGF-β-deficient neonatal mice receive galectin-1 injections to prolong survival (typically 3-4 weeks after birth in these mice.) Cells stably producing antigenic proteins (e.g. proTGF-β1-GARP or TGF-β1 LAP-GARP; 1-4×106 cells in 10-25 μl PBS) or purified antigenic proteins are used to immunize the mice every other day by intraperitoneal injection for 10 days beginning on the 8$^{th}$ day after birth. Spleen cells are harvested on day 22 after birth. Harvested spleen cells are fused with SP 2/0 myeloma cells. Resulting hybridoma cells are assessed for successful production of anti-proTGF-β1 antibodies.

Example 22

Figure 11:
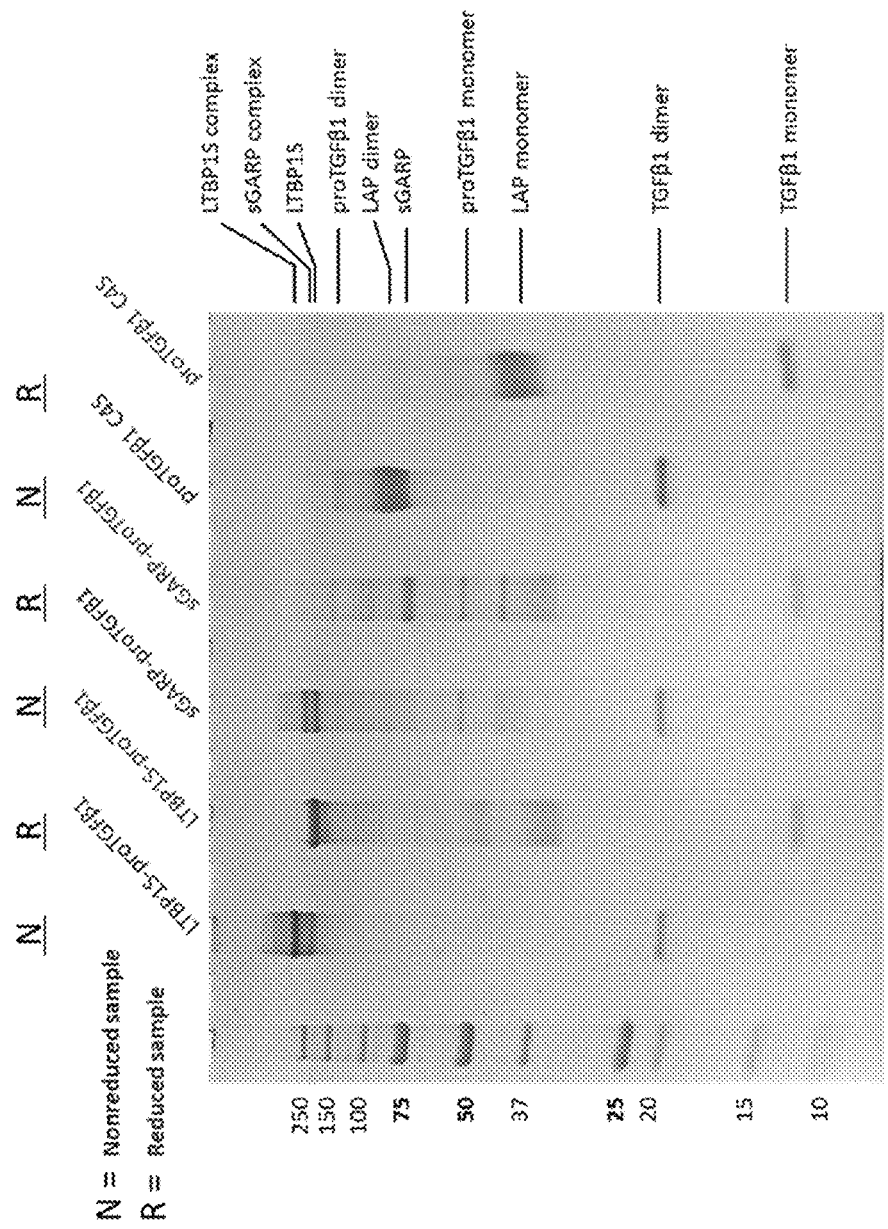
FIG. 11 depicts the expression and purification of recombinant antigens and antigen complexes (Coomassie Blue stained SDS-PAGE).

Expression of TGF-β1 Complexes and Protein Analysis proTGF-β1 expression was carried out with or without His-tagged LTBP1S or sGARP according to the methods of Example 10. proTGF-β1 expressed without LTBP1S or sGARP comprised C4S mutation to prevent prodomain association with these factors and an N-terminal His tag. Purified proteins were analyzed by SDS-PAGE under either reducing or non-reducing conditions (to maintain protein dimers or complexes). FIG. 11 depicts the results indicating successful expression of these proteins and protein complexes.

Example 23

Cell-Based Antigen Expression of TGF-β1/GARP Complexes

Figure 12:
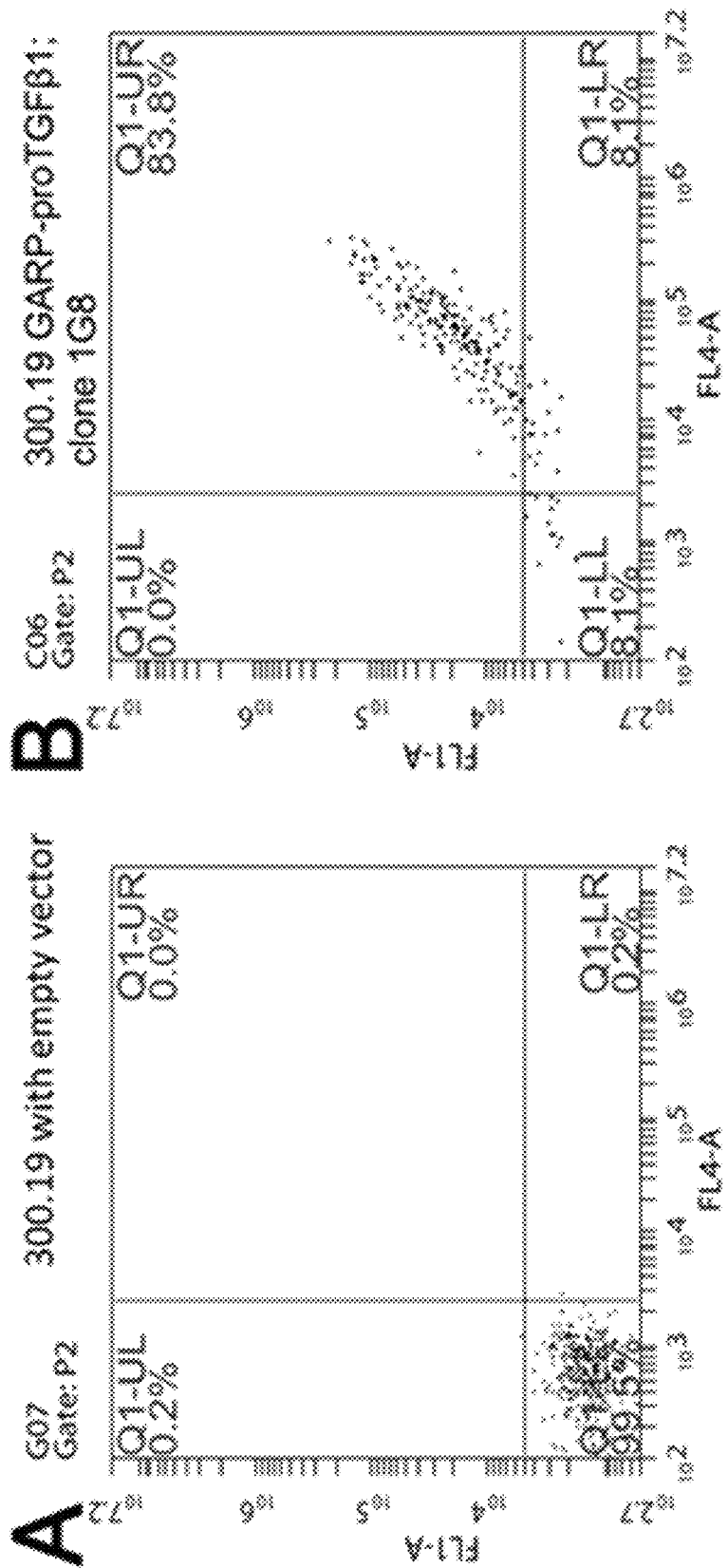
FIG. 12 presents results from analyses of cell lines stably expressing TGF-β1/GARP complexes. 300.19 cells stably transfected with empty vector control (A), proTGF-β1-GARP (B) or TGF-β1 LAP-GARP (C) were fluorescently labeled with antibodies directed to expressed proteins and examined for fluorescence intensity by flow cytometry. Luciferase assay data is presented in (D) showing TGF-β signaling activity resulting from co-culture of these cells with cells expressing $\alpha v\beta_6$ integrin.
Figure 12:
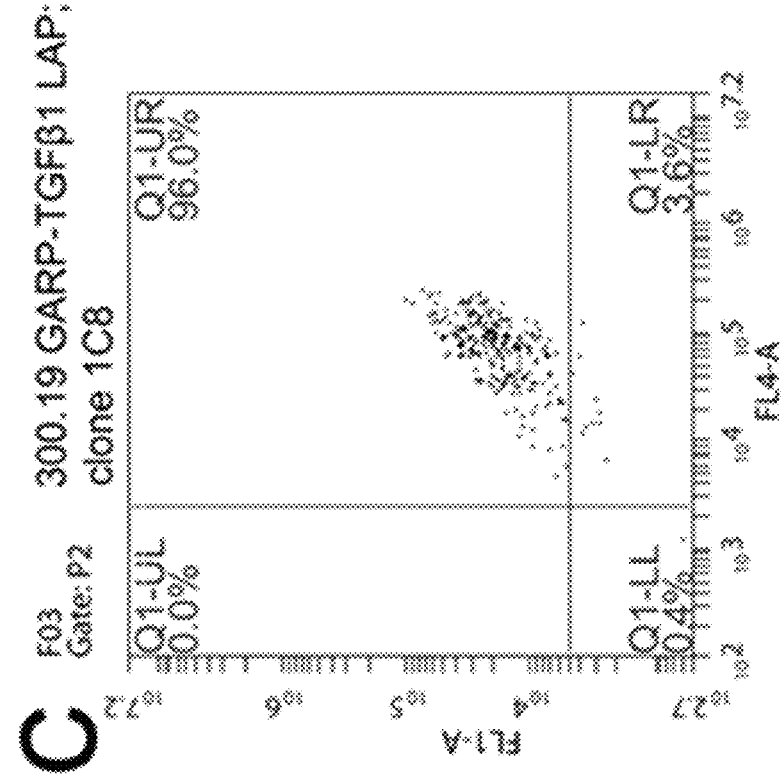

Pro B-cell lymphoma cell lines were developed that stably express both (membrane-bound) GARP and proTGF-β1 or TGF-β1 LAP. Membrane-associated GARP was cloned into pYD7 vector (NRC Canada, Ottawa, CA) while proTGF-β1 and TGF-β1 LAP were cloned into pcDNA3.1 vectors (Life Technologies, Carlsbad, Calif.) These vectors allow for blasticidin and G418-based selection, respectively. Pre-B-cell lymphoma-derived cells from BALB/c swiss mice (referred to herein as 300.19 cells) were transfected with empty vector control or GARP with coexpression of either proTGF-β1 or TGF-β1 LAP and selected with G418 plus blasticidin. Resistant cells were subcloned and single colonies were selected. Cells cultured from resulting cell lines were probed with antibodies (conjugated with fluorescent particles) directed to expressed proteins and examined by flow cytometry for fluorescence intensity. FIG. 12 displays fluorescence intensity data collected from resulting cells. Baseline values associated with cells transfected with empty vector control are shown in FIG. 12A, while elevated fluorescence intensity in FIGS. 12B and 12C indicate cell surface expression of GARP complexes. Quantification of surface-expressed proteins was carried out through additional analyses in which the same fluorescently labeled cells used to generate the data depicted in FIG. 12, were examined by flow cytometry alongside beads with defined antibody binding capacity for the generation of a standard curve. These beads were labeled with the same antibodies used for labeling cells and fluorescence values obtained were used to extrapolate the number of antibodies bound to surface expressed proteins. 300.19 cells expressing proTGF-β1-GARP were determined to express about 83,000 copies/cell, while 300.19 cells expressing TGF-β1 LAP-GARP were determined to express about 66,000 copies/cell.

Cell lines were next tested for TGF-β1 activity in the presence of cells expressing αvβ6 integrins, known to release TGF-β1 growth factor from latent GPCs. Conditioned media from these co-cultures was used to treat reporter cells comprising TGF-β receptors as well as the luciferase gene, driven by a TGF-β-responsive promoter, PAI-1. This was done in the presence or absence of a neutralizing antibody, anti-TGF-β, clone 1D11. Resulting luciferase activity was assessed by luminometry. Results indicate that conditioned media from cells expressing empty vectors and TGF-β1 LAP-GARP complexes were unable to induce luciferase expression when compared to baseline values, while conditioned media from cells expressing proTGF-β1-GARP displayed an enhanced ability to induce luciferase expression (see FIG. 12D.)

Example 24

Cell-Based Antigen Expression of proTGF-β1-LTBP1

NIH 3T3 mouse fibroblasts are developed that stably express proTGF-β1-LTBP1. These secreted proteins bind to the cell surface or are deposited in the extracellular matrix.

Example 25

LTBP3 Expression

Recombinant LTBP3 proteins are expressed with or without various modules, fragments, N-terminal secretion signal sequences (e.g. SEQ ID NO: 257) and/or N- or C-terminal histidine tags. Modules included in some expressed proteins include those listed in Table 19.

TABLE 19

LTBP3 modules

| Protein | Sequence | SEQ ID NO |
|---|---|---|
| LTBP3 EGF-like domain, module 1 | DIDECMLFGSEICKEGKCVNTQPGYECYCKQGF YYDGNLLECVDVDECLDESNCRNGVCENTRGGY RCACTPPAEYSPAQRQCLSP | 274 |
| LTBP3 EGF-like domain, module 2 | DVDECQDPAACRPGRCVNLPGSYRCECRPPWVP GPSGRDCQLP | 275 |
| LTBP3 EGF-like domain, module 3 | DIDECSQDPSLCLPHGACKNLQGSYVCVCDEGF TPTQDQHGCE | 276 |
| LTBP3 EGF-like domain, module 4 | DIDECMLFGSEICKEGKCVNTQPGYECYCKQG FYYDGNLLECV | 277 |
| TB domain, module 1 | KKECYLNFDDTVFCDSVLATNVTQQECCCSLGA GWGDHCEIYPCPVYSSAEFHSLCP | 278 |
| TB domain, module 2 | DVCWSQRGEDGMCAGPLAGPALTFDDCCCRQGR GWGAQCRPCPPRGAGSHCP | 279 |

LTBP3 fragments included in some expressed proteins include those listed in Table 20.

TABLE 20

LTBP3 fragments

| Protein | Sequence | SEQ ID NO |
|---|---|---|
| L3-TB3TB4 isoform 1 | KKECYLNFDDTVFCDSVLATNVTQQECCCSLGAGW GDHCEIYPCPVYSSAEFHSLCPDGKGYTQDNNIVN YGIPAHRDIDECMLFGSEICKEGKCVNTQPGYECY CKQGFYYDGNLLECVDVDECLDESNCRNGVCENTR GGYRCACTPPAEYSPAQRQCLSPEEMDVDECQDPA ACRPGRCVNLPGSYRCECRPPWVPGPSGRDCQLPE SPAERAPERRDVCWSQRGEDGMCAGPLAGPALTFD DCCCRQGRGWGAQCRPCPPRGAGSHCPTSQSE | 280 |
| L3-TB3TB4 isoform 2 | KKECYLNFDDTVFCDSVLATNVTQQECCCSLGAGW GDHCEIYPCPVYSSAEFHSLCPDGKGYTQDNNIVN YGIPAHRDIDECMLFGSEICKEGKCVNTQPGYECY CKQGFYYDGNLLECVDVDECLDESNCRNGVCENTR GGYRCACTPPAEYSPAQRQCLSPEEMERAPERRDV CWSQRGEDGMCAGPLAGPALTFDDCCCRQGRGWGA QCRPCPPRGAGSHCPTSQSE | 281 |
| L3-ETB3E, type 1 | DIDECSQDPSLCLPHGACKNLQGSYVCVCDEGFTP TQDQHGCEEVEQPHHKKECYLNFDDTVFCDSVLAT NVTQQECCCSLGAGWGDHCEIYPCPVYSSAEFHSL CPDGKGYTQDNNIVNYGIPAHRDIDECMLFGSEIC KEGKCVNTQPGYECYCKQGFYYDGNLLECVDVDE | 282 |
| L3-ETB3E, type 2 | QDIDECSQDPSLCLPHGACKNLQGSYVCVCDEGFT PTQDQHGCEEVEQPHHKKECYLNFDDTVFCDSVLA TNVTQQECCCSLGAGWGDHCEIYPCPVYSSAEFHS LCPDGKGYTQDNNIVNYGIPAHRDIDECMLFGSEI CKEGKCVNTQPGYECYCKQGFYYDGNLLECVDVDE | 283 |
| L3-ETB3E, type 3 | DIDECSQDPSLCLPHGACKNLQGSYVCVCDEGFTP TQDQHGCEEVEQPHHKKECYLNFDDTVFCDSVLAT NVTQQECCCSLGAGWGDHCEIYPCPVYSSAEFHSL CPDGKGYTQDNNIVNYGIPAHRDIDECMLFGSEIC KEGKCVNTQPGYECYCKQGFYYDGNLLECV | 284 |
| L3-ETB3E, type 4 | QDIDECSQDPSLCLPHGACKNLQGSYVCVCDEGFT PTQDQHGCEEVEQPHHKKECYLNFDDTVFCDSVLA TNVTQQECCCSLGAGWGDHCEIYPCPVYSSAEFHS LCPDGKGYTQDNNIVNYGIPAHRDIDECMLFGSEI CKEGKCVNTQPGYECYCKQGFYYDGNLLECV | 285 |

Further proteins expressed include those listed in Table 21.

TABLE 21

LTBP3 recombinant proteins

| Protein | Sequence | SEQ ID NO |
|---|---|---|
| L3-TB3TB4 isoform 1 | MDMRVPAQLLGLLLLWFSGVLGKKECYLNFDDTVF CDSVLATNVTQQECCCSLGAGWGDHCEIYPCPVYS SAEFHSLCPDGKGYTQDNNIVNYGIPAHRDIDECM LFGSEICKEGKCVNTQPGYECYCKQGFYYDGNLLE CVDVDECLDESNCRNGVCENTRGGYRCACTPPAEY SPAQRQCLSPEEMDVDECQDPAACRPGRCVNLPGS YRCECRPPWVPGPSGRDCQLPESPAERAPERRDVC WSQRGEDGMCAGPLAGPALTFDDCCCRQGRGWGAQ CRPCPPRGAGSHCPTSQSEHHHHHH | 286 |
| L3-TB3TB4 isoform 2 | MDMRVPAQLLGLLLLWFSGVLGKKECYLNFDDTVF CDSVLATNVTQQECCCSLGAGWGDHCEIYPCPVYS SAEFHSLCPDGKGYTQDNNIVNYGIPAHRDIDECM LFGSEICKEGKCVNTQPGYECYCKQGFYYDGNLLE CVDVDECLDESNCRNGVCENTRGGYRCACTPPAEY SPAQRQCLSPEEMERAPERRDVCWSQRGEDGMCAG PLAGPALTFDDCCCRQGRGWGAQCRPCPPRGAGSH CPTSQSEHHHHHH | 287 |

TABLE 21-continued

LTBP3 recombinant proteins

| Protein | Sequence | SEQ ID NO |
|---|---|---|
| L3-ETB3E, type 1C | MDMRVPAQLLGLLLLWFSGVLGDIDECSQDPSLCL PHGACKNLQGSYVCVCDEGFTPTQDQHGCEEVEQP HHKKECYLNFDDTVFCDSVLATNVTQQECCCSLGA GWGDHCEIYPCPVYSSAEFHSLCPDGKGYTQDNNI VNYGIPAHRDIDECMLFGSEICKEGKCVNTQPGYE CYCKQGFYYDGNLLECVDVDEHHHHHH | 288 |
| His-L3-ETB3E, type 1N | MDMRVPAQLLGLLLLWFSGVLGHHHHHHSSGDIDE CSQDPSLCLPHGACKNLQGSYVCVCDEGFTPTQDQ HGCEEVEQPHHKKECYLNFDDTVFCDSVLATNVTQ QECCCSLGAGWGDHCEIYPCPVYSSAEFHSLCPDG KGYTQDNNIVNYGIPAHRDIDECMLFGSEICKEGK CVNTQPGYECYCKQGFYYDGNLLECVDVDE | 289 |
| His-L3-ETB3E, type 2 | MDMRVPAQLLGLLLLWFSGVLGHHHHHHSSGQDID ECSQDPSLCLPHGACKNLQGSYVCVCDEGFTPTQD QHGCEEVEQPHHKKECYLNFDDTVFCDSVLATNVT QQECCCSLGAGWGDHCEIYPCPVYSSAEFHSLCPD GKGYTQDNNIVNYGIPAHRDIDECMLFGSEICKEG KCVNTQPGYECYCKQGFYYDGNLLECVDVDE | 290 |
| His-L3-ETB3E, type 3 | MDMRVPAQLLGLLLLWFSGVLGHHHHHHSSGDIDE CSQDPSLCLPHGACKNLQGSYVCVCDEGFTPTQDQ HGCEEVEQPHHKKECYLNFDDTVFCDSVLATNVTQ QECCCSLGAGWGDHCEIYPCPVYSSAEFHSLCPDG KGYTQDNNIVNYGIPAHRDIDECMLFGSEICKEGK CVNTQPGYECYCKQGFYYDGNLLECV | 291 |
| His-L3-ETB3E, type 4 | MDMRVPAQLLGLLLLWFSGVLGHHHHHHSSGQDID ECSQDPSLCLPHGACKNLQGSYVCVCDEGFTPTQD QHGCEEVEQPHHKKECYLNFDDTVFCDSVLATNVT QQECCCSLGAGWGDHCEIYPCPVYSSAEFHSLCPD GKGYTQDNNIVNYGIPAHRDIDECMLFGSEICKEG KCVNTQPGYECYCKQGFYYDGNLLECV | 292 |

Example 26

293T CAGA-Luciferase Assay for GDF-8 Activity

CAGA-luciferase assays are carried out to test antibodies that modulate GDF-8 activity. A 50 µg/ml solution of fibronectin is prepared and 100 µl are added to each well of a 96-well plate. Plates are incubated for 30 min at room temperature before free fibronectin is washed away using PBS. 293T cells comprising transient or stable expression of pGL4 (Promega, Madison, Wis.) under the control of a control promoter or promoter comprising smad1/2 responsive CAGA sequences are then used to seed fibronectin-coated wells ($2\times10^4$ cell/well in complete growth medium.) The next day, cells are washed with 150 µl/well of cell culture medium with 0.1% bovine serum albumin (BSA) before treatment with GDF-8 with or without test antibody. Cells are incubated at 37° for 6 hours before detection of luciferase expression using BRIGHT-GLO™ reagent (Promega, Madison, Wis.) according to manufacturer's instructions.

Example 27

Detection of Myogenin Expression by FACS

257384 Lonza cells (Lonza, Basel, Switzerland) are plated in 24-well plates at $4\times10^4$ cells/well. The next day, cell media is replaced with differentiation media [dulbecco's modified eagle medium (DMEM)/F12 with 2% horse serum.] Varying concentrations of GDF-8 are also included in differentiation media in the presence or absence of test antibodies. Cells are then allowed to differentiate for 3 days.

After the 3 day period, differentiation status of each well is analyzed through analysis of myogenin expression levels. Cells from each treatment group are pooled and subjected to treatment using the Transcription Factor Buffer Set from BD Pharmingen (BD Biosciences, Franklin Lakes, N.J.), product number 562574 according to manufacturers instructions. After fixation and permeabilization, 5 µl of phycoerythrin (PE)-myogenin or 1.25 µl of PE-control are added to the cells and incubated at 4° C. for 50 mins. Cells are then washed and resuspended in FACS buffer before analysis of cellular fluorescence by FACS.

Example 28

HT2 Cell Proliferation Assay

Antibodies are tested for the ability to modulate TGF-β activity using an HT2 cell proliferation assay. HT2 cell proliferation in IL-4-containing medium is reduced in the presence of free TGF-β growth factor. Antibodies with the ability to modulate free growth factor levels by stabilizing TGF-β GPCs or by promoting the release and/or accumulation of free growth factor may be tested using the HT2 culture system described here. Cells expressing proTGF-β are co-cultured with cells expressing $\alpha v\beta_6$ integrins. Cultures are treated with various concentrations of test antibody, purified TGF-β1 (as a positive control) or anti-TGF-β antibody 1D11 (R&D Systems, Minneapolis, Minn.) as a negative control.

HT2 cells are cultured in growth media (RPMI 1640, 10% FBS, 1% P/S, 4 mM Gln, 50 µM beta-mercaptoethanol and 10 ng/mL IL-2) at $1.5\times10^5$ cells/ml to ensure that cells are in log growth phase on the following day. The next day, cell supernatants being tested are diluted in HT2 assay media (RPMI 1640, 10% FBS, 1% P/S, 4 mM Gln, 50 µM beta-mercaptoethanol and 7.5 ng/mL IL-4.) Growth media is removed from HT2 cell cultures and cells are washed with cytokine free media. Diluted supernatants are added to each HT2 cell culture well and HT2 cells are cultured for 48 hours at 37° C. and 5% CO2. Cell viability in the HT2 cell cultures is then determined using CELL-TITER GLO® reagent (Promega, Madison, Wis.) according to manufacturers instructions. Results are obtained as relative light units (RLUs) which correlate with cell viability.

Example 29

Analysis of Recombinantly Expressed GDF-8

Histidine-tagged proGDF-8 was expressed according to the methods of Example 10. Purified proteins were analyzed by SDS-PAGE under either reducing or non-reducing conditions (to maintain protein dimers). FIG. 13 depicts the results indicating successful expression of these proteins and protein complexes.

Example 30

TGF-β2 Chimeras

Chimeric proteins are synthesized that comprise TGF-β2 with arm region substitutions from TGF-β1 and TGF-β3. The chimeric proteins also comprise N-terminal C5S mutations. These expressed chimeric proteins (listed in Table 22) have improved stability over some other chimeric proteins.

TABLE 22

TGF-β2 chimeric proteins.

| Protein module 1 | Protein module 2 | Chimeric Sequence | SEQ ID NO |
|---|---|---|---|
| TGF-β2 LAP | TGF-β1 arm region | SLSTSSTLDMDQFMRKRIEAIRGQILSKLKL TSPPEDYPEPEEVPPEVLALYNSTRDRVAGE SAEPEPEPEADYYAKEVTRVLMVETHNEIYD KFKQSTHSIYMFFNTSELREAVPEPVLLSRA ELRLLRLKLKVEQHVELYQKYSNNSWRYLSN RLLAPSDSPEWLSFDVTGVVRQWLSRGGEIE GFRLSAHCSCDSRDNTLQVDINGFTTGRRGD LATIHGMNRPFLLLMATPLERAQHLQSSR HRR | 293 |
| TGF-β2 LAP | TGF-β3 arm region | SLSTSSTLDMDQFMRKRIEAIRGQILSKLKL TSPPEDYPEPEEVPPEVLALYNSTRELLEEM HGEREEGCTQENTESEYYAKEIHKFDMIQGL AEHNELAVCPKGITSKVFRFNVSSVEKNRTN LFRAEFRVLRVPNPSSKRNEQRIELFQILRP DEHIAKQRYIGGKNLPTRGTAEWLSFDVTDT VREWLLRRESNLGLEISIHCPCHTFQPNGDI LENIHEVMEIKFKGVDNEDDHGRGDLGRLKK QKDHHNPHLILMMIPPHRLDNPGQGGQRKKR | 294 |

SEQUENCE LISTING (297 sequences)

SEQ ID NO: 1 - protein, 361 aa, Homo sapiens
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 2 - protein, 395 aa, Homo sapiens
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 3 - protein, 392 aa, Homo sapiens
SLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 4 - protein, 383 aa, Homo sapiens
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 5 - protein, 352 aa, Homo sapiens [sequence omitted]

SEQ ID NO: 6 - protein, 406 aa, Homo sapiens
SPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 7 - protein, 379 aa, Homo sapiens
SPTPPPTPAAPPPPPPPGSPGGSQDTCTSCGGFRRPEELGRVDGDFLEAVKRHILSRLQMRGRPNITHAVPKAAMVTALRKLHAGKVREDGRVEIPHLDGHASPGADGQERVSEIISFAETDGLASSRVRLYFFISNEGNQNLFVVQASLWLYLKLLPYVLEKGSRRKVRVKVYFQEQGHGDRWNMVEKRVDLKRSGWHTFPLTEAIQALFERGERRLNLDVQCDSCQELAVVPVFVDPGEESHRPFVVVQARLGDSRHRIRKRGLECDGRTNLCCRQQFFIDFRLIGWNDWIIAPTGYYGNYCEGSCPAYLAGVPGSASSFHTAVVNQYRMRGLNPGTVNSCCIPTKLSTMSMLYFDDEYNIVKRDVPNMIVEECGCA

SEQ ID NO: 8 - protein, 334 aa, Homo sapiens
TPRAGGQCPACGGPTLELESQRELLLDLAKRSILDKLHLTQRPTLNRPVSRAALRTALQHLHGVPQGALLEDNREQECEIISFAETGLSTINQTRLDFHFSSDRTAGDREVQQASLMFFVQLPSNTTWTLKVRVLVLGPHNTNLTLATQYLLEVDASGWHQLPLGPEAQAACSQGHLTLELVLEGQVAQSSVILGGAAHRPFVAARVRVGGKHQIHRRGIDCQGGSRMCCRQEFFVDFREIGWHDWIIQPEGYAMNFCIGQCPLHIAGMPGIAASFHTAVLNLLKANTAAGTTGGGSCCVPTARRPLSLLYYDRDSNIVKTDIPDMVVEACGCS

SEQ ID NO: 9 - protein, 331 aa, Homo sapiens
QGTGSVCPSCGGSKLAPQAERALVLELAKQQILDGLHLTSRPRITHPPPQAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLDHNGNVVKTDVPDMVVEACGCS

SEQ ID NO: 10 - protein, 345 aa, Homo sapiens
LTGEQLLGSLLRQLQLKEVPTLDRADMEELVIPTHVRAQYVALLQRSHGDRSRGKRFSQSFREVAGRFLALEASTHLLVFGMEQRLPPNSELVQAVLRLFQEPVPKAALHRHGRLSPRSARARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLGDYGAQGDCDPEAPMTEGTRCCRQEMYIDLQGMKWAENWVLEPPGFLAYECVGTCRQPPEALAFKWPFLGPRQCIASETDSLPMIVSIKEGGRTRPQVVSLPNMRVQKCSCASDGALVPRRLQP

SEQ ID NO: 11 - protein, 345 aa, Homo sapiens
LTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 12 - protein, 279 aa, Homo sapiens
LSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 13 - protein, 542 aa, Homo sapiens
LLGTEALRAEEPAVGTSGLIFREDLDWPPGIPQEPLCLVALGGDSNGSSSPLRVVGALSAYEQAFLGAVQRARWGPRDLATFGVCNTGDRQAALPSLRRLGAWLRDPGGQRLVVLHLEEVTWEPTPSLRFQEPPPGGAGPPELALLVLYPGPGPEVTVTRAGLPGAQSLCPSRDTRYLVLAVDRPAGAWRGSGLALTLQPRGEDSRLSTARLQALLFGDDHRCFTRMTPALLLLPRSEPAPLPAHGQLDTVPFPPPRPSAELEESPPSADPFLETLTRLVRALRVPPARASAPRLALDPDALAGFPQGLVNLSDPAALERLLDGEEPLLLLLRPTAATTGDPAPLHDPTSAPWATALARRVAAELQAAAAELRSLPGLPPATAPLLARLLALCPGGPGGLGDPLRALLLLKALQGLRVEWRGRDPRGPGRAQRSAGATAADGPCALRELSVDLRAERSVLIPETYQANNCQGVCGWPQSDRNPRYGNHVVLLLKMQVRGAALARPPCCVPTAYAGKLLISLSEERISAHHVPNMVATECGCR

SEQ ID NO: 14 - protein, 348 aa, Homo sapiens
CQGLELARELVLAKVRALFLDALGPPAVTREGGDPGVRRLPRRHALGGFTHRGSEPEEEEDVSQAILFPATDASCEDKSAARGLAQEAEEGLFRYMFRPSQHTRSRQVTSAQLWFHTGLDRQGTAASNSSEPLLGLLALSPGGPVAVPMSLGHAPPHWAVLHLATSALSLLTHPVLVLLLRCPLCTCSARPEATPFLVAHTRTRPPSGGERARRSTPLMSWPWSPSALRLLQRPPEEPAAHANCHRVALNISFQELGWERWIVYPPSFIFHYCHGGCGLHIPPNLSLPVPGAPPTPAQPYSLLPGAQPCCAALPGTMRPLHVRTTSDGGYSFKYETVPNLLTQHCACI

SEQ ID NO: 15 - protein, 343 aa, Homo sapiens
PVPPGPAAALLQALGLRDEPQGAPRLRPVPPVMWRLFRRRDPQETRSGSRRTSPGVTLQPCHVEELGVAGNIVRHIPDRGAPTRASEPASAAGHCPEWTVVFDLSAVEPAERPSRARLELRFAAAAAAAPEGGWELSVAQAGQGAGADPGPVLLRQLVPALGPPVRAELLGAAWARNASWPRSLRLALALRPRAPAACARLAEASLLLVTLDPRLCHPLARPRRDAEPVLGGGPGGACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 16 - protein, 340 aa, Homo sapiens
QEYVFLQFLGLDKAPSPQKFQPVPYILKKIFQDREAAATTGVSRDLCYVKELGVRGNVLRFLPDQGFFLYPKKISQASSCLQKLLYFNLSAIKEREQLTLAQLGLDLGPNSYYNLGPELELALFLVQEPHVWGQTTPKPGKMFVLRSVPWPQGAVHFNLLDVAKDWNDNPRKNFGLFLEILVKEDRDSGVNFQPEDTCARLRCSLHASLLVVTLNPDQCHPSRKRRAAIPVPKLSCKNLCHRHQLFINFRDLGWHKWIIAPKGFMANYCHGECPFSLTISLNSSNYAFMQALMHAVDPEIPQAVCIPTKLSPISMLYQDNNDNVILRHYEDMVVDECGCG

SEQ ID NO: 17 - protein, 474 aa, Homo sapiens
APDLGQRPQGTRPGLAKAEAKERPPLARNVFRPGGHSYGGGATNANARAKGGTGQTGGLTQPKKDEPKKLPPRPGGPEPKPGHPPQTRQATARTVTPKGQLPGGKAPPKAGSVPSSFLLKKAREPGPPREPKEPFRPPPITPHEYMLSLYRTLSDADRKGGNSSVKLEAGLANTITSFIDKGQDDRGPVVRKQRYVFDISALEKDGLLGAELRILRKKPSDTAKPAAPGGGRAAQLKLSSCPSGRQPASLLDVRSVPGLDGSGWEVFDIWKLFRNFKNSAQLCLELEAWERGRAVDLRGLGFDRAARQVHEKALFLVFGRTKKRDLFFNEIKARSGQDDKTVYEYLFSQRRKRRAPLATRQGKRPSKNLKARCSRKALHVNFKDMGWDDWIIAPLEYEAFHCEGLCEFPLRSHLEPTNHAVIQTLMNSMDPESTPPTCCVPTRLSPISILFIDSANNVVYKQYEDMVVESCGCR

SEQ ID NO: 18 - protein, 433 aa, Homo sapiens
FQQASISSSSSSAELGSTKGMRSRKEGKMQRAPRDSDAGREGQEPQPRPQDEPRAQQPRAQEPPGRGPRVVPHEYMLSIYRTYSIAEKLGINASFFQSSKSANTITSFVDRGLDDLSHTPLRRQKYLFDVSMLSDKEELVGAELRLFRQAPSAPWGPPAGPLHVQLFPCLSPLLLDARTLDPQGAPPAGWEVFDVWQGLRHQPWKQLCLELRAAWGELDAGEAEARARGPQQPPPPDLRSLGFGRRVRPPQERALLVVFTRSQRKNLFAEMREQLGSAEAAGPGAGAEGSWPPPSGAPDARPWLPSPGRRRRRTAFASRHGKRHGKKSRLRCSKKPLHVNFKELGWDDWIIAPLEYEAYHCEGVCDFPLRSHLEPTNHAIIQTLMNSMDPGSTPPSCCVPTKLTPISILYIDAGNNVVYKQYEDMVVESCGCR

SEQ ID NO: 19 - protein, 431 aa, Homo sapiens
RDGLEAAAVLRAAGAGPVRSPGGGGGGGGGGRTLAQAAGAAAVPAAAVPRARAARRAAGSGFRNGSVVPHHFMMSLYRSLAGRAPAGAAAVSASGHGRADTITGFTDQATQDESAAETGQSFLFDVSSLNDADEVVGAELRVLRRGSPESGPGSWTSPPLLLLSTCPGAARAPRLLYSRAAEPLVGQRWEAFDVADAMRRHRREPRPPRAFCLLLRAVAGPVPSPLALRRLGFGWPGGGGSAAEERAVLVVSSRTQRKESLFREIRAQARALGAALASEPLPDPGTGTASPRAVIGGRRRRRTALAGTRTAQGSGGGAGRGHGRRGRSRCSRKPLHVDFKELGWDDWIIAPLDYEAYHCEGLCDFPLRSHLEPTNHAIIQTLLNSMAPDAAPASCCVPARLSPISILYIDAANNVVYKQYEDMVVEACGCR

SEQ ID NO: 20 - protein, 403 aa, Homo sapiens
SPIMNLEQSPLEEDMSLFGDVFSEQDGVDFNTLLQSMKDEFLKTLNLSDIPTQDSAKVDPPEYMLELYNKFATDRTSMPSANIIRSFKNEDLFSQPVSFNGLRKYPLLFNVSIPHHEEVIMAELRLYTLVQRDRMIYDGVDRKITIFEVLESKGDNEGERNMLVLVSGEIYGTNSEWETFDVTDAIRRWQKSGSSTHQLEVHIESKHDEAEDASSGRLEIDTSAQNKHNPLLIVFSDDQSSDKERKEELNEMISHEQLPELDNLGLDSFSSGPGEEALLQMRSNIIYDSTARIRRNAKGNYCKRTPLYIDFKEIGWDSWIIAPPGYEAYECRGVCNYPLAEHLTPTKHAIIQALVHLKNSQKASKACCVPTKLEPISILYLDKGVVTYKFKYEGMAVSECGCR

SEQ ID NO: 21 - protein, 407 aa, Homo sapiens
KPLQSWGRGSAGGNAHSPLGVPGGGLPEHTFNLKMFLENVKVDFLRSLNLSGVPSQDKTRVEPPQYMIDLYNRYTSDKSTTPASNIVRSFSMEDAISITATEDFPFQKHILLFNISIPRHEQITRAELRLYVSCQNHVDPSHDLKGSVVIYDVLDGTDAWDSATETKTFLVSQDIQDEGWETLEVSSAVKRWVRSDSTKSKNKLEVTVESHRKGCDTLDISVPPGSRNLPFFVVFSNDHSSGTKETRLELREMISHEQESVLKKLSKDGSTEAGESSHEEDTDGHVAAGSTLARRKRSAGAGSHCQKTSLRVNFEDIGWDSWIIAPKEYEAYECKGGCFFPLADDVTPTKHAIVQTLVHLKFPTKVGKACCVPTKLSPISVLYKDDMGVPTLKYHYEGMSVAECGCR

SEQ ID NO: 22 - protein, 325 aa, Homo sapiens
TVATALLRTRGQPSSPSPLAYMLSLYRDPLPRADIIRSLQAEDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKRPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 23 - protein, 373 aa, Homo sapiens
LVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 24 - protein, 389 aa, Homo sapiens
GASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 25 - protein, 424 aa, Homo sapiens
DNHVHSSFIYRRLRNHERREIQREILSILGLPHRPRPFSPGKQASSAPLFMLDLYNAMTNEENPEESEYSVRASLAEETRGARKGYPASPNGYPRRIQLSRTTPLTTQSPPLASLHDTNFLNDADMVMSFVNLVERDKDFSHQRRHYKEFRFDLTQIPHGEAVTAAEFRIYKDRSNNRFENETIKISIYQIIKEYTNRDADLFLLDTRKAQALDVGWLVFDITVTSNHWVINPQNNLGLQLCAETGDGRSINVKSAGLVGRQGPQSKQPFMVAFFKASEVLLRSVRAANKRKNQNRNKSSSHQDSSRMSSVGDYNTSEQKQACKKHELYVSFRDLGWQDWIIAPEGYAAFYCDGECSFPLNAHMNATNHAIVQTLVHLMFPDHVPKPCCAPTKLNAISVLYFDDSSNVILKKYRNMVVRSCGCH

SEQ ID NO: 26 - protein, 493 aa, Homo sapiens
CCGPPPLRPPLPAAAAAAAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 27 - protein, 402 aa, Homo sapiens
DFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 28 - protein, 383 aa, Homo sapiens
GGGPGLRPPPGCPQRRLGARERRDVQREILAVLGLPGRPRPRAPPAASRLPASAPLFMLDLYHAMAGDDDEDGAPAEQRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVRGSHGRQVCRRHELYVSFQDLGWLDWVIAPQGYSAYYCEGECSFPLDSCMNATNHAILQSLVHLMKPNAVPKACCAPTKLSATSVLYYDSSNNVILRKHRNMVVKACGCH

SEQ ID NO: 29 - protein, 383 aa, Homo sapiens
GGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVHGSHGRQVCRRHELYVSFQDLGWLDWVIAPQGYSAYYCEGECSFPLDSCMNATNHAILQSLVHLMMPDAVPKACCAPTKLSATSVLYYDSSNNVILRKHRNMVVKACGCH

SEQ ID NO: 30 - protein, 374 aa, Homo sapiens
MEHRAQMAEGGQSSIALLAEAPTLPLIEELLEESPGEQPRKPRLLGHSLRYMLELYRRSADSHGHPRENRTIGATMVRLVKPLTSVARPHRGTWHIQILGFPLRPNRGLYQLVRATVVYRHHLQLTRFNLSCHVEPWVQKNPTNHFPSSEGDSSKPSLMSNAWKEMDITQLVQQRFWNNKGHRILRLRFMCQQQKDSGGLELWHGTSSLDIAFLLLYFNDTHKSIRKAKFLPRGMEEFMERESLLRRTRQADGISAEVTASSSKHSGPENNQCSLHPFQISFRQLGWDHWIIAPPFYTPNYCKGTCLRVLRDGLNSPNHAIIQNLINQLVDQSVPRPSCVPYKYVPISVLMIEANGSILYKEYEGMIAESCTCR

SEQ ID NO: 31 - protein, 430 aa, Homo sapiens
SQASGGEAQIAASAELESGAMPWSLLQHIDERDRAGLLPALFKVLSVGRGGSPRLQPDSRALHYMKKLYKTYATKEGIPKSNRSHLYNTVRLFTPCTRHKQAPGDQVTGILPSVELLFNLDRITTVEHLLKSVLLYNINNSVSFSSAVKCVCNLMIKEPKSSSRTLGRAPYSFTFNSQFEFGKKHKWIQIDVTSLLQPLVASNKRSIHMSINFTCMKDQLEHPSAQNGLFNMTLVSPSLILYLNDTSAQAYHSWYSLHYKRRPSQGPDQERSLSAYPVGEEAAEDGRSSHHRHRRGQETVSSELKKPLGPASFNLSEYFRQFLLPQNECELHDFRLSFSQLKWDNWIVAPHRYNPRYCKGDCPRAVGHRYGSPVHTMVQNIIYEKLDSSVPRPSCVPAKYSPLSVLTIEPDGSIAYKEYEDMIATKCTCR

SEQ ID NO: 32 - protein, 450 aa, Homo sapiens
ERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQLLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 33 - protein, 445 aa, Homo sapiens
SHRAPAWSALPAAADGLQGDRDLQRHPGDAAATLGPSAQDMVAVHMHRLYEKYSRQGARPGGGNTVRSFRARLEVVDQKAVYFFNLTSMQDSEMILTATFHFYSEPPRWPRALEVLCKPRAKNASGRPLPLGPPTRQHLLFRSLSQNTATQGLLRGAMALAPPPRGLWQAKDISPIVKAARRDGELLLSAQLDSEERDPGVPRPSPYAPYILVYANDLAISEPNSVAVTLQRYDPFPAGDPEPRAAPNNSADPRVRRAAQATGPLQDNELPGLDERPPRAHAQHFHKHQLWPSPFRALKPRPGRKDRRKKGQEVFMAASQVLDFDEKTMQKARRKQWDEPRVCSRRYLKVDFADIGWNEWIISPKSFDAYYCAGACEFPMPKIVRPSNHATIQSIVRAVGIIPGIPEPCCVPDKMNSLGVLFLDENRNVVLKVYPNMSVDTCACR

SEQ ID NO: 34 - protein, 192 aa, Homo sapiens
FPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 35 - protein, 178 aa, Homo sapiens
IWMCREGLLLSHRLGPALVPLHRLPRTLDARIARLAQYRALLQGAPDAMELRELTPWAGRPPGPRRRAGPRRRRARARLGARPCGLRELEVRVSELGLGYASDETVLFRYCAGACEAAARVYDLGLRRLRQRRRLRRERVRAQPCCRPTAYEDEVSFLDAHSRYHTVHELSARECACV

SEQ ID NO: 36 - protein, 135 aa, Homo sapiens
WGPDARGVPVADGEFSSEQVAKAGGTWLGTHRPLARLRRALSGPCQLWSLTLSVAELGLGYASEEKVIFRYCAGSCPRGARTQHGLALARLQGQGRAHGGPCCRPTRYTDVAFLDDRHRWQRLPQLSAAACGCGG

SEQ ID NO: 37 - protein, 181 aa, Homo sapiens
SLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 38 - protein, 249 aa, Homo sapiens
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRR

SEQ ID NO: 39 - protein, 283 aa, Homo sapiens
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKR

SEQ ID NO: 40 - protein, 280 aa, Homo sapiens
SLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKR

SEQ ID NO: 41 - protein, 45 aa, Homo sapiens
LSTCKTIDMELVKRKRIEAIRGQILSKLRLASPPSQGEVPPGPLP

SEQ ID NO: 42 - protein, 45 aa, Homo sapiens
SLSTCSTLDMDQFMRKRIEAIRGQILSKLKLTSPPEDYPEPEEVP

SEQ ID NO: 43 - protein, 46 aa, Homo sapiens
SLSLSTCTTLDFGHIKKKRVEAIRGQILSKLRLTSPPEPTVMTHVP

SEQ ID NO: 44 - protein, 112 aa, Homo sapiens
ALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 45 - protein, 112 aa, Homo sapiens
ALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 46 - protein, 112 aa, Homo sapiens [sequence omitted]

SEQ ID NO: 47 - protein, 4 aa, Homo sapiens
RHRR

SEQ ID NO: 48 - protein, 4 aa, Homo sapiens
RKKR

SEQ ID NO: 49 - protein, 204 aa, Homo sapiens
EAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRR

SEQ ID NO: 50 - protein, 238 aa, Homo sapiens
PEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKR

SEQ ID NO: 51 - protein, 234 aa, Homo sapiens
YQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKR

SEQ ID NO: 52 - protein, 29 aa, Homo sapiens
CVRQLYIDFRKDLGWKWIHEPKGYHANFC

SEQ ID NO: 53 - protein, 30 aa, Homo sapiens
CLRPLYIDFKRDLGWKWIHEPKGYNANFCA

SEQ ID NO: 54 - protein, 30 aa, Homo sapiens
CVRPLYIDFRQDLGWKWVHEPKGYYANFCS

SEQ ID NO: 55 - protein, 35 aa, Homo sapiens
CVPQALEPLPIVYYVGRKPKVEQLSNMIVRSCKCS

SEQ ID NO: 56 - protein, 35 aa, Homo sapiens
CVSQDLEPLTILYYIGKTPKIEQLSNMIVKSCKCS

SEQ ID NO: 57 - protein, 35 aa, Homo sapiens
CVPQDLEPLTILYYVGRTPKVEQLSNMVVKSCKCS

SEQ ID NO: 58 - protein, 15 aa, Homo sapiens
LASPPSQGEVPPGPL

SEQ ID NO: 59 - protein, 13 aa, Homo sapiens
LTSPPEDYPEPEE

SEQ ID NO: 60 - protein, 13 aa, Homo sapiens
LTSPPEPTVMTHV

SEQ ID NO: 61 - protein, 29 aa, Homo sapiens
LSTCKTIDMELVKRKRIEAIRGQILSKLR

SEQ ID NO: 62 - protein, 29 aa, Homo sapiens
LSTCSTLDMDQFMRKRIEAIRGQILSKLK

SEQ ID NO: 63 - protein, 31 aa, Homo sapiens
LSLSTCTTLDFGHIKKKRVEAIRGQILSKLR

SEQ ID NO: 64 - protein, 20 aa, Homo sapiens
NGFTTGRRGDLATIHGMNRP

SEQ ID NO: 65 - protein, 30 aa, Homo sapiens
FAGIDGTSTYTSGDQKTIKSTRKKNSGKTP

SEQ ID NO: 66 - protein, 25 aa, Homo sapiens
GVDNEDDHGRGDLGRLKKQKDHHNP

SEQ ID NO: 67 - protein, 13 aa, Homo sapiens
CSCDSRDNTLQVD

SEQ ID NO: 68 - protein, 24 aa, Homo sapiens
CPCCTFVPSNNYIIPNKSEELEAR

SEQ ID NO: 69 - protein, 23 aa, Homo sapiens
CPCHTFQPNGDILENIHEVMEIK

SEQ ID NO: 70 - protein, 243 aa, Homo sapiens
NENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 71 - protein, 274 aa, Homo sapiens
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 72 - protein, 64 aa, Homo sapiens
NENSEQKENVEKEGLCNACTWRQNTKSSRIEAIKIQILSKLRLETAPNISKDVIRQLLPKAPPL

SEQ ID NO: 73 - protein, 86 aa, Homo sapiens
AEGPAAAAAAAAAAAAAGVGGERSSRPAPSVAPEPDGCPVCVWRQHSRELRLESIKSQILSKLRLKEAPNISREVVKQLLPKAPPL

SEQ ID NO: 74 - protein, 109 aa, Homo sapiens
DFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 75 - protein, 109 aa, Homo sapiens
NLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 76 - protein, 4 aa, Homo sapiens
RSRR

SEQ ID NO: 77 - protein, 179 aa, Homo sapiens
RELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 78 - protein, 188 aa, Homo sapiens
QQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 79 - protein, 29 aa, Homo sapiens
CRYPLTVDFEAFGWDWIIAPKRYKANYCS

SEQ ID NO: 80 - protein, 36 aa, Homo sapiens
CTPTKMSPINMLYFNGKEQIIYGKIPAMVVDRCGCS

SEQ ID NO: 81 - protein, 36 aa, Homo sapiens
CTPTKMSPINMLYFNDKQQIIYGKIPGMVVDRCGCS

SEQ ID NO: 82 - protein, 23 aa, Homo sapiens
RLETAPNISKDVIRQLLPKAPPL

SEQ ID NO: 83 - protein, 22 aa, Homo sapiens
RLKEAPNISREVVKQLLPKAPP

SEQ ID NO: 84 - protein, 27 aa, Homo sapiens
GLCNACTWRQNTKSSRIEAIKIQILSK

SEQ ID NO: 85 - protein, 28 aa, Homo sapiens
DGCPVCVWRQHSRELRLESIKSQILSKL

SEQ ID NO: 86 - protein, 14 aa, Homo sapiens
DENGHDLAVTFPGP

SEQ ID NO: 87 - protein, 13 aa, Homo sapiens
DPSGTDLAVTSLG

SEQ ID NO: 88 - protein, 290 aa, Homo sapiens
SPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRR

SEQ ID NO: 89 - protein, 65 aa, Homo sapiens
SPTPGSEGHSAAPDCPSCALAALPKDVPNSQPEMVEAVKKHILNMLHLKKRPDVTQPVPKAALLN

SEQ ID NO: 90 - protein, 117 aa, Homo sapiens
RGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 91 - protein, 4 aa, Homo sapiens
RRRR

SEQ ID NO: 92 - protein, 227 aa, Homo sapiens
LNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRR

SEQ ID NO: 93 - protein, 28 aa, Homo sapiens
KKQFFVSFKDIGWNDWIIAPSGYHANYC

SEQ ID NO: 94 - protein, 36 aa, Homo sapiens
CVPTKLRPMSMLYYDDGQNIIKKDIQNMIVEECGCS

SEQ ID NO: 95 - protein, 17 aa, Homo sapiens
LKKRPDVTQPVPKAALL

SEQ ID NO: 96 - protein, 28 aa, Homo sapiens
ALAALPKDVPNSQPEMVEAVKKHILNML

SEQ ID NO: 97 - protein, 33 aa, Homo sapiens
QESGASLVLLGKKKKKEEEGEGKKKGGGEGGAG

SEQ ID NO: 98 - protein, 361 aa, Artificial Sequence
  Description of Artificial Sequence: Synthetic polypeptide
LSTSKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 99 - protein, 249 aa, Artificial Sequence
  Description of Artificial Sequence: Synthetic polypeptide
LSTSKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRR

SEQ ID NO: 100 - protein, 360 aa, Artificial Sequence
  Description of Artificial Sequence: Synthetic polypeptide
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHGALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 101 - protein, 360 aa, Artificial Sequence
  Description of Artificial Sequence: Synthetic polypeptide
LSTSKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHGALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 102 - protein, 395 aa, Artificial Sequence
  Description of Artificial Sequence: Synthetic polypeptide
SLSTSSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 103 - protein, 283 aa, Artificial Sequence
  Description of Artificial Sequence: Synthetic polypeptide
SLSTSSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKR

SEQ ID NO: 104 - protein, 394 aa, Artificial Sequence
  Description of Artificial Sequence: Synthetic polypeptide
SLSTSSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKGALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 105 - protein, 394 aa, Artificial Sequence
  Description of Artificial Sequence: Synthetic polypeptide
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKGALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 106 - protein, 392 aa, Artificial Sequence
  Description of Artificial Sequence: Synthetic polypeptide
SLSLSTSTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 107 - protein, 280 aa, Artificial Sequence
  Description of Artificial Sequence: Synthetic polypeptide
SLSLSTSTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKR

SEQ ID NO: 108 - protein, 391 aa, Artificial Sequence
  Description of Artificial Sequence: Synthetic polypeptide
SLSLSTSTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKGALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 109 - protein, 391 aa, Artificial Sequence
  Description of Artificial Sequence: Synthetic polypeptide
SLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKGALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 110 - protein, 361 aa, Artificial Sequence
  Description of Artificial Sequence: Synthetic polypeptide
LSTCKTIDMELVKRKRIEAIRGQILSKLRLASPPSQGEVPPGPLPEAVLALHNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 111 - protein, 361 aa, Artificial Sequence
  Description of Artificial Sequence: Synthetic polypeptide
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFCLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 112 - protein, 361 aa, Artificial Sequence
  Description of Artificial Sequence: Synthetic polypeptide
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSADCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 113 - protein, 361 aa, Artificial Sequence
  Description of Artificial Sequence: Synthetic polypeptide
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHRSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 114 - protein, 361 aa, Artificial Sequence
  Description of Artificial Sequence: Synthetic polypeptide
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSRDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 115 - protein, 361 aa, Artificial Sequence
  Description of Artificial Sequence: Synthetic polypeptide
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHRSRDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 116 - protein, 361 aa, Mus sp.
LSTCKTIDMELVKRKRIEAIRGQILSKLRLASPPSQGEVPPGPLPEAVLALYNSTRDRVAGESADPEPEPEADYYAKEVTRVLMVDRNNAIYEKTKDISHSIYMFFNTSDIREAVPEPPLLSRAELRLQRLKSSVEQHVELYQKYSNNSWRYLGNRLLTPTDTPEWLSFDVTGVVRQWLNQGDGIQGFRFSAHCSCDSKDNKLHVEINGISPKRRGDLGTIHDMNRPFLLLMATPLERAQHLHSSRHRRALDTNYCFSSTEKNCCVRQLYIDFRKDLGWKWIHEPKGYHANFCLGPCPYIWSLDTQYSKVLALYNQHNPGASASPCCVPQALEPLPIVYYVGRKPKVEQLSNMIVRSCKCS

SEQ ID NO: 117 - protein, 361 aa, Macaca fascicularis
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSKDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 118 - protein, 249 aa, Mus sp.
LSTSKTIDMELVKRKRIEAIRGQILSKLRLASPPSQGEVPPGPLPEAVLALYNSTRDRVAGESADPEPEPEADYYAKEVTRVLMVDRNNAIYEKTKDISHSIYMFFNTSDIREAVPEPPLLSRAELRLQRLKSSVEQHVELYQKYSNNSWRYLGNRLLTPTDTPEWLSFDVTGVVRQWLNQGDGIQGFRFSAHCSCDSKDNKLHVEINGISPKRRGDLGTIHDMNRPFLLLMATPLERAQHLHSSRHRR

SEQ ID NO: 119 - protein, 249 aa, Macaca fascicularis
LSTSKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSKDNTLQVDINGFTTGRRGDLATIHGMNRPFLLLMATPLERAQHLQSSRHRR

SEQ ID NO: 120 - protein, 360 aa, Mus sp.
LSTSKTIDMELVKRKRIEAIRGQILSKLRLASPPSQGEVPPGPLPEAVLALYNSTRDRVAGESADPEPEPEADYYAKEVTRVLMVDRNNAIYEKTKDISHSIYMFFNTSDIREAVPEPPLLSRAELRLQRLKSSVEQHVELYQKYSNNSWRYLGNRLLTPTDTPEWLSFDVTGVVRQWLNQGDGIQGFRFSAHCSCDSKDNKLHVEINGISPKRRGDLGTIHDMNRPFLLLMATPLERAQHLHSSRHGALDTNYCFSSTEKNCCVRQLYIDFRKDLGWKWIHEPKGYHANFCLGPCPYIWSLDTQYSKVLALYNQHNPGASASPCCVPQALEPLPIVYYVGRKPKVEQLSNMIVRSCKCS

SEQ ID NO: 121 - protein, 361 aa, Mus sp.
LSTSKTIDMELVKRKRIEAIRGQILSKLRLASPPSQGEVPPGPLPEAVLALYNSTRDRVAGESADPEPEPEADYYAKEVTRVLMVDRNNAIYEKTKDISHSIYMFFNTSDIREAVPEPPLLSRAELRLQRLKSSVEQHVELYQKYSNNSWRYLGNRLLTPTDTPEWLSFDVTGVVRQWLNQGDGIQGFRFSAHCSCDSKDNKLHVEINGISPKRRGDLGTIHDMNRPFLLLMATPLERAQHLHSSRHRRALDTNYCFSSTEKNCCVRQLYIDFRKDLGWKWIHEPKGYHANFCLGPCPYIWSLDTQYSKVLALYNQHNPGASASPCCVPQALEPLPIVYYVGRKPKVEQLSNMIVRSCKCS

SEQ ID NO: 122 - protein, 361 aa, Macaca fascicularis
LSTSKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSKDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 123 - protein, 360 aa, Macaca fascicularis
LSTSKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSKDNTLQVDINGFTTGRRGDLATIHGMNRPFLLLMATPLERAQHLQSSRHGALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 124 - protein, 662 aa, Macaca fascicularis
MSPQILLLLALLTLGLAAQHQDKVACKMVDKKVSCQGLGLLQVPLVLPPDTETLDLSGNQLRSILASPLGFYTALRHLDLSTNEINFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPHLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSTPNGNVSARPLSQLLNLDLSYNEIELIPDSFLEHLTSLCFLNLSRNCLRTFEARRSGSLPCLMLLDLSHNALETLELGARALGSLRTLLLQGNALRDLPPYTFANLASLQRLNLQGNRVSPCGGPNEPGPASCVAFSGIASLRSLSLVDNEIELLRAGAFLHTPLTELDLSSNPGLEVATGALTGLEASLEVLALQGNGLTVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNINLIIILTFILVSAILLTTLATCCCVRRQKFNQQYKA

SEQ ID NO: 125 - protein, 352 aa, Mus sp.
NEGSEREENVEKEGLCNACAWRQNTRYSRIEAIKIQILSKLRLETAPNISKDAIRQLLPRAPPLRELIDQYDVQRDDSSDGSLEDDDYHATTETIITMPTESDFLMQADGKPKCCFFKFSSKIQYNKVVKAQLWIYLRPVKTPTTVFVQILRLIKPMKDGTRYTGIRSLKLDMSPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 126 - protein, 352 aa, Mus sp.
NEGSEREENVEKEGLCNACAWRQNTRYSRIEAIKIQILSKLRLETAPNISKDAIRQLLPRAPPLRELIDQYDVQRDDSSDGSLEDDDYHATTETIITMPTESDFLMQADGKPKCCFFKFSSKIQYNKVVKAQLWIYLRPVKTPTTVFVQILRLIKPMKDGTRYTGIRSLKLDMSPGTGIWQSIDVKTVLQNWLKQPESNLGIEIKALDENGHDLAVTFPGPGEDGLNPFLEVKVTDTPKASRADFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 127 - protein, 352 aa, Mus sp.
NEGSEREENVEKEGLCNACAWRQNTRYSRIEAIKIQILSKLRLETAPNISKDAIRQLLPRAPPLRELIDQYDVQRADSSDGSLEDDDYHATTETIITMPTESDFLMQADGKPKCCFFKFSSKIQYNKVVKAQLWIYLRPVKTPTTVFVQILRLIKPMKDGTRYTGIRSLKLDMSPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 128 - protein, 352 aa, Mus sp.
NEGSEREENVEKEGLCNACAWRQNTRYSRIEAIKIQILSKLRLETAPNISKDAIRQLLPRAPPLRELIDQYDVQRADSSDGSLEDDDYHATTETIITMPTESDFLMQADGKPKCCFFKFSSKIQYNKVVKAQLWIYLRPVKTPTTVFVQILRLIKPMKDGTRYTGIRSLKLDMSPGTGIWQSIDVKTVLQNWLKQPESNLGIEIKALDENGHDLAVTFPGPGEDGLNPFLEVKVTDTPKASRADFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 129 - protein, 243 aa, Mus sp.
NEGSEREENVEKEGLCNACAWRQNTRYSRIEAIKIQILSKLRLETAPNISKDAIRQLLPRAPPLRELIDQYDVQRDDSSDGSLEDDDYHATTETIITMPTESDFLMQADGKPKCCFFKFSSKIQYNKVVKAQLWIYLRPVKTPTTVFVQILRLIKPMKDGTRYTGIRSLKLDMSPGTGIWQSIDVKTVLQNWLKQPESNLGIEIKALDENGHDLAVTFPGPGEDGLNPFLEVKVTDTPKRSRR

SEQ ID NO: 130 - protein, 243 aa, Mus sp.
NEGSEREENVEKEGLCNACAWRQNTRYSRIEAIKIQILSKLRLETAPNISKDAIRQLLPRAPPLRELIDQYDVQRADSSDGSLEDDDYHATTETIITMPTESDFLMQADGKPKCCFFKFSSKIQYNKVVKAQLWIYLRPVKTPTTVFVQILRLIKPMKDGTRYTGIRSLKLDMSPGTGIWQSIDVKTVLQNWLKQPESNLGIEIKALDENGHDLAVTFPGPGEDGLNPFLEVKVTDTPKRSRR

SEQ ID NO: 131 - protein, 352 aa, Macaca fascicularis
NENSEQKENVEKEGLCNACTWRQNTKSSRIEAIKIQILSKLRLETAPNISKDAIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 132 - protein, 352 aa, Macaca fascicularis
NENSEQKENVEKEGLCNACTWRQNTKSSRIEAIKIQILSKLRLETAPNISKDAIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKASRADFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 133 - protein, 352 aa, Macaca fascicularis
NENSEQKENVEKEGLCNACTWRQNTKSSRIEAIKIQILSKLRLETAPNISKDAIRQLLPKAPPLRELIDQYDVQRADSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 134 - protein, 352 aa, Macaca fascicularis
NENSEQKENVEKEGLCNACTWRQNTKSSRIEAIKIQILSKLRLETAPNISKDAIRQLLPKAPPLRELIDQYDVQRADSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKASRADFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 135 - protein, 243 aa, Macaca fascicularis
NENSEQKENVEKEGLCNACTWRQNTKSSRIEAIKIQILSKLRLETAPNISKDAIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 136 - protein, 243 aa, Macaca fascicularis
NENSEQKENVEKEGLCNACTWRQNTKSSRIEAIKIQILSKLRLETAPNISKDAIRQLLPKAPPLRELIDQYDVQRADSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 137 - protein, 381 aa, Mus sp.
AEGPAAAAAAAAAAAGVGGERSSRPAPSAPPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 138 - protein, 381 aa, Mus sp.
AEGPAAAAAAAAAAAGVGGERSSRPAPSAPPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKASRANLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 139 - protein, 381 aa, Mus sp.
AEGPAAAAAAAAAAAGVGGERSSRPAPSAPPEPDGCPVCVWRQHSRELRLESIKSQILSKLRLKEAPNISREVVKQLLPKAPPLQQILDLHDFQGAALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKASRANLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 140 - protein, 381 aa, Mus sp.; identical to SEQ ID NO: 137

SEQ ID NO: 141 - protein, 272 aa, Mus sp.
AEGPAAAAAAAAAAAGVGGERSSRPAPSAPPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 142 - protein, 272 aa, Mus sp.
AEGPAAAAAAAAAAAGVGGERSSRPAPSAPPEPDGCPVCVWRQHSRELRLESIKSQILSKLRLKEAPNISREVVKQLLPKAPPLQQILDLHDFQGAALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 143 - protein, 1298 aa, Macaca fascicularis
MPGPRGAPGGLAPEMRGAGAAGLLALLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRAGALSTGALPPLAPEGDSVASKHAIYAVQVIADPPGPGEGPPAQHAAFLVPLGPGQISAEVQAPPPVVNVRVHHPPEASVQVHRIESSNAEGAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPADGTAAFKEICPAGKGYHILTSHQTLTIQGESDFSLFLHPDGPPKPQQLPESPSQAPPPEDTEEERGVTTDSPVSEERSVQQSHPTATTSPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCVDVDECEAGDVCDNGICTNTPGSFQCQCLSGYHLSRDRSHCEDIDECDFPAACIGGDCINTNGSYRCLCPQGHRLVGGRKCQDIDECTQDPGLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGAEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPQAGPALTFDDCCCRQGRGWGAQCRPCPPRGAGSQCPTSQSESNSFWDTSPLLLGKPRRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 144 - protein, 1268 aa, Mus sp.
MPGPRGAAHGLAPAMHQAGALGLLALLLLALLGPGGGAEGGPAGERGTGGGGALARERFKVVFAPVICKRTCLKGQCRDSCQQGSNMTLIGENGHSTDTLTGSAFRVVVCPLPCMNGGQCSSRNQCLCPPDFTGRFCQVPAAGTGAGTGSSGPGLARTGAMSTGPLPPLAPEGESVASKHAIYAVQVIADPPGPGEGPPAQHAAFLVPLGPGQISAEVQAPPPVVNVRVHHPPEASVQVHRIEGPNAEGPASSQHLLPHPKPPHPRPPTQKPLGRCFQDTLPKQPCGSNPLPGLTKQEDCCGSIGTAWGQSKCHKCPQLQYTGVQKPVPVRGEVGADCPQGYKRLNSTHCQDINECAMPGNVCHGDCLNNPGSYRCVCPPGHSLGPLAAQCIADKPEEKSLCFRLVSTEHQCQHPLTTRLTRQLCCCSVGKAWGARCQRCPADGTAAFKEICPGKGYHILTSHQTLTIQGESDFSLFLHPDGPPKPQQLPESPSRAPPLEDTEEERGVTMDPPVSEERSVQQSHPTTTTSPPRPYPELISRPSPPTFHRFLPDLPPSRSAVEIAPTQVTETDECRLNQNICGHGQCVPGPSDYSCHCNAGYRSHPQHRYCVDVNECEAEPCGPGKGICMNTGGSYNCHCNRGYRLHVGAGGRSCVDLNECAKPHLCGDGGFCINFPGHYKCNCYPGYRLKASRPPICEDIDECRDPSTCPDGKCENKPGSFKCIACQPGYRSQGGGACRDVNECSEGTPCSPGWCENLPGSYRCTCAQYEPAQDGLSCIDVDECEAGKVCQDGICTNTPGSFQCQCLSGYHLSRDRSRCEDIDECDFPAACIGGDCINTNGSYRCLCPLGHRLVGGRKCKKDIDECSQDPGLCLPHACENLQGSYVCVCDEGFTLTQDQHGCEEVEQPHHKKECYLNFDDTVFCDSVLATNVTQQECCCSLGAGWGDHCEIYPCPVYSSAEFHSLVPDGKRLHSGQQHCELCIPAHRDIDECILFGAEICKEGKCVNTQPGYECYCKQGFYYDGNLLECVDVDECLDESNCRNGVCENTRGGYRCACTPPAEYSPAQAQCLIPERWSTPQRDVKCAGASEERTACVWGPWAGPALTFDDCCCRQPRLGTQCRPCPPRGTGSQCPTSQSESNSFWDTSPLLLGKSPRDEDSSEEDSDECRCVSGRCVPRPGGAVCECPGGFQLDASRARCVDIDECRELNQRGLLCKSERCVNTSGSFRCVCKAGFTRSRPHGPACLSAAADDAAIAHTSVIDHRGYFH

SEQ ID NO: 145 - protein, 1719 aa, Macaca fascicularis
MAGAWLRWGLLLWAGLLASSAHGRLRRITYVVHPGPGLAAGALPLSGPPRSRTFNVALNARYSRSSAAAGAPSRASPGVPSERTRRTSKPGGAALQGLRPPPPPPPEPARPAAPGGQLHPKPGGHPAAAPFAKQGRQVVRSKVPQETQSSGGSRLQVHQKQQLQGVNVCGGRCCHGWSKAPGSQRCTKRSCVPPCQNGGMCLRPQLCVCKPGTKGKACETIAAQDTSSPVFGGQSPGAASSWGPPEQAAKHTSSKKADTLPRVSPVAQMTLTLKPKPSVGLPQQIHSQVTPLSSQSVMIHHSQTQEYVLKPKYFPAQKGISGEQSTEGSFPLRYVQDQVAAPFQLSNHTGRIKVVFTPSICKVTCTKGSCQNSCEKGNTTTLISENGHAADTLTATNFRVVLCHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYKFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCTNGDCSNLEGSYMCSCHKGYTRTPDHKHCKDIDECQQGNLCVNGQCKNTEGSFRCTCGQGYQLSAAKDQCEDIDECQHHHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVEQPKEEKKECYYNLNDASLCDNVLAPNVTKQECCCTSGAGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPMKDSDDYAQLCNIPVTGRRQPYGRDALVDFSEQYAPEADPYFIQDRFLNSFEELQAEECGILNGCENGRCVRVQEGYTCDCFDGYHLDTAKMTCVDVNECDELNNRMSLCKNAKCINTEGSYKCLCLPGYVPSDKPNYCTPLNTALNLEKDSDLE

SEQ ID NO: 146 - protein, 1374 aa, Mus sp.
NHTGRIKVVFTPSICKVTCTKGNCQNSCQKGNTTTLISENGHAADTLTATNFRVVICHLPCMNGGQCSSRDKCQCPPNFTGKLCQIPVLGASMPKLYQHAQQQGKALGSHVIHSTHTLPLTMTSQQGVKVKFPPNIVNIHVKHPPEASVQIHQVSRIDSPGGQKVKEAQPGQSQVSYQGLPVQKTQTVHSTYSHQQLIPHVYPVAAKTQLGRCFQETIGSQCGKALPGLSKQEDCCGTVGTSWGFNKCQKCPKKQSYHGYTQMMECLQGYKRVNNTFCQDINECQLQGVCPNGECLNTMGSYRCSCKMGFGPDPTFSSCVPDPPVISEEKGPCYRLVSPGRHCMHPLSVHLTKQICCCSVGKAWGPHCEKCPLPGTAAFKEICPGGMGYTVSGVHRRRPIHQHIGKEAVYVKPKNTQPVAKSTHPPPLPAKEEPVEALTSSWEHGPRGAEPEVVTAPPEKEIPSLDQEKTRLEPGQPQLSPGVSTIHLHPQFPVVVEKTSPPVPVEVAPEASTSSASQVIAPTQVTEINECTVNPDICGAGHCINLPVRYTCICYEGYKFSEQLRKCVDIDECAQVRHLCSQGRCENTEGSFLCVCPAGFMASEEGTNCIDVDECLRPDMCRDGRCINTAGAFRCEYCDSGYRMSRRGYCEDIDECLKPSTCPEEQCVNTPGSYQCVPCTEGFRGWNGQCLDVDECLQPKVCTNGSCTNLEGSYMCSCHRGYSPTPDHRHCQDIDECQQGNLCMNGQCRNTDGSFRCTCGQGYQLSAAKDQCEDIDECEHHHLCSHGQCRNTEGSFQCVCNQGYRASVLGDHCEDINECLEDSSVCQGGDCINTAGSYDCTCPDGFQLNDNKGCQDINECAQPGLCGSHGECLNTQGSFHCVCEQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRVTEDSGVDRQPREEKKECYYNLNDASLCDNVLAPNVTKQECCCTSGAGWGDNCEIFPCPVQGTAEFTEMCPRGKGLVPAGESSYDTGGENYKDADECLLFGEEICKNGYCLNTQPGYECYCKQGTYYDPVKLQCFDMDECQDPNSCIDGQCVNTEGSYNCFCTHPMVLDASEKRCVQPTESNEQIEETDVYQDLCWEHLSEEYVCSRPLVGKQTTYTECCCLYGEAWGMQCALCPMKDSDDYAQLCNIPVTGRRRPYGRDALVDFSEQYGPETDPYFIQDRFLNSFEELQAEECGILNGCENGRCVRVQEGYTCDCFDGYHLDMAKMTCVDVNECSELNNRMSLCKNAKCINTEGSYKCLCLPGYIPSDKPNYCTPLNSALNLDKESDLE

SEQ ID NO: 147 - protein, 646 aa, Mus sp.
ISQRREQVPCRTVNKEALCHGLGLLQVPSVLSLDIQALYLSGNQLQSILVSPLGFYTALRHLDLSDNQISFLQAGVFQALPYLEHLNLAHNRLATGMALNSGGLGRLPLLVSLDLSGNSLHGNLVERLLGETPRLRTLSLAENSLTRLARHTFWGMPAVEQLDLHSNVLMDIEDGAFEALPHLTHLNLSRNSLTCISDFSLQQLQVLDLSCNSIEAFQTAPEPQAQFQLAWLDLRENKLLHFPDLAVFPRLIYLNVSNNLIQLPAGLPRGSEDLHAPSEGWSASPLSNPSRNASTHPLSQLLNLDLSYNEIELVPASFLEHLTSLRFLNLSRNCLRSFEARQVDSLPCLVLLDLSHNVLEALELGTKVLGSLQTLLLQDNALQELPPYTFASLASLQRLNLQGNQVSPCGGPAEPGPPGCVDFSGIPTLHVLNMAGNSMGMLRAGSFLHTPLTELDLSTNPGLDVATGALVGLEASLEVLELQGNGLTVLRVDLPCFLRLKRLNLAENQLSHLPAWTRAVSLEVLDLRNNSFSLLPGNAMGGLETSLRRLYLQGNPLSCCGNGWLAAQLHQGRVDVDATQDLICRFGSQEELSLSLVRPEDCEKGGLKNVNLILLLSFTLVSAIVLTTLATICFLRRQKLSQQYKA

SEQ ID NO: 148 - protein, 611 aa, Mus sp.
ISQRREQVPCRTVNKEALCHGLGLLQVPSVLSLDIQALYLSGNQLQSILVSPLGFYTALRHLDLSDNQISFLQAGVFQALPYLEHLNLAHNRLATGMALNSGGLGRLPLLVSLDLSGNSLHGNLVERLLGETPRLRTLSLAENSLTRLARHTFWGMPAVEQLDLHSNVLMDIEDGAFEALPHLTHLNLSRNSLTCISDFSLQQLQVLDLSCNSIEAFQTAPEPQAQFQLAWLDLRENKLLHFPDLAVFPRLIYLNVSNNLIQLPAGLPRGSEDLHAPSEGWSASPLSNPSRNASTHPLSQLLNLDLSYNEIELVPASFLEHLTSLRFLNLSRNCLRSFEARQVDSLPCLVLLDLSHNVLEALELGTKVLGSLQTLLLQDNALQELPPYTFASLASLQRLNLQGNQVSPCGGPAEPGPPGCVDFSGIPTLHVLNMAGNSMGMLRAGSFLHTPLTELDLSTNPGLDVATGALVGLEASLEVLELQGNGLTVLRVDLPCFLRLKRLNLAENQLSHLPAWTRAVSLEVLDLRNNSFSLLPGNAMGGLETSLRRLYLQGNPLSCCGNGWLAAQLHQGRVDVDATQDLICRFGSQEELSLSLVRPEDCEKGGLKNVN

SEQ ID NO: 149 - protein, 675 aa, Mus sp.
WRSGPGTATAASQGGCKVVDGVADCRGLNLASVPSSLPPHSRMLILDANPLKDLWNHSLQAYPRLENLSLHSCHLDRISHYAFREQGHLRNLVLADNRLSENYKESAAALHTLLGLRRLDLSGNSLTEDMAALMLQNLSSLEVVSLARNTLMRLDDSIFEGLEHLVELDLQRNYIFEIEGGAFDGLTELRRLNLAYNNLPCIVDFSLTQLRFLNVSYNILEWFLAAREEVAFELEILDLSHNQLLFFPLLPQCGKLHTLLLQDNNMGFYRELYNTSSPQEMVAQFLLVDGNVTNITTVNLWEEFSSSDLSALRFLDMSQNQFRHLPDGFLKKTPSLSHLNLNQNCLKMLHIREHEPPGALTELDLSHNQLAELHLAPGLTGSLRNLRVFNLSSNQLLGVPTGLFDNASSITTIDMSHNQISLCPQMVPVDWEGPPSCVDFRNMGSLRSLSLDGCGLKALQDCPFQGTSLTHLDLSSNWGVLNGSISPLWAVAPTLQVLSLRDVGLGSGAAEMDFSAFGNLRALDLSGNSLTSFPKFKGSLALRTLDLRRNSLTALPQRVVSEQPLRGLQTIYLSQNPYDCCGVEGWGALQQHFKTVADLSMVTCNLSSKIVRVVELPEGLPQGCKWEQVDTGLFYLVLILPSCLTLLVACTVVFLTFKKPLLQVIKSRCHWSSIY

SEQ ID NO: 150 - protein, 633 aa, Mus sp.
WRSGPGTATAASQGGCKVVDGVADCRGLNLASVPSSLPPHSRMLILDANPLKDLWNHSLQAYPRLENLSLHSCHLDRISHYAFREQGHLRNLVLADNRLSENYKESAAALHTLLGLRRLDLSGNSLTEDMAALMLQNLSSLEVVSLARNTLMRLDDSIFEGLEHLVELDLQRNYIFEIEGGAFDGLTELRRLNLAYNNLPCIVDFSLTQLRFLNVSYNILEWFLAAREEVAFELEILDLSHNQLLFFPLLPQCGKLHTLLLQDNNMGFYRELYNTSSPQEMVAQFLLVDGNVTNITTVNLWEEFSSSDLSALRFLDMSQNQFRHLPDGFLKKTPSLSHLNLNQNCLKMLHIREHEPPGALTELDLSHNQLAELHLAPGLTGSLRNLRVFNLSSNQLLGVPTGLFDNASSITTIDMSHNQISLCPQMVPVDWEGPPSCVDFRNMGSLRSLSLDGCGLKALQDCPFQGTSLTHLDLSSNWGVLNGSISPLWAVAPTLQVLSLRDVGLGSGAAEMDFSAFGNLRALDLSGNSLTSFPKFKGSLALRTLDLRRNSLTALPQRVVSEQPLRGLQTIYLSQNPYDCCGVEGWGALQQHFKTVADLSMVTCNLSSKIVRVVELPEGLPQGCKWEQVDTGL

SEQ ID NO: 151 - protein, 674 aa, Macaca fascicularis
WRDRSVTATAASQRGCKLVGGDTDCRGQSLASVPSSLPPHARTLILDANPLKALWNHSLQPYPLLESLSLHSCHLERIGRGAFQEQGHLRSLVLGDNCLSENYKETAAALHTLPGLQTLDLSGNSLTEDMAALMLQNLSSLQSVSLARNTIMRLDDSVFEGLERLRELDLQRNYIFEIEGGAFDGLTELRHLNLAYNNLPCIVDFGLTQLRSLNVSYNVLEWFLAAGGEAAFELETLDLSHNQLLFFPLLPQYSKLHTLLLRDNNMGFYRDLYNTSSPREMVAQFLLVDGNVTNITTVNLWEEFSSSDLADLRFLDMSQNQFQYLPDGFLRKMPSLSHLNLNQNCLMTLHIREHEPPGALTELDLSHNQLSELHLTPGLASCLGSLRLFNLSSNQLLGVPPGLFANARNITTLDMSHNQISLCPLPAASDRVGPPSCVDFRNMASLRSLSLEGCGLGALPDCPFQGTSLTSLDLSSNWGVLNGSLAPLRDVAPMLQVLSLRNMGLHSNFMALDFSGFGNLRDLDLSGNCLTTFPRFGGSLALETLDLRRNSLTALPQKAVSEQLSRGLRTIYLSQNPYDCCGVDGWGALQQGQTVADWATVTCNLSSKIIRLAELPGGVPRDCKWERLDLGLLYLVLILPSCLTLLVACTLIVLTFKKPLLQVIKSRCHWSSVY

SEQ ID NO: 152 - protein, 632 aa, Macaca fascicularis
WRDRSVTATAASQRGCKLVGGDTDCRGQSLASVPSSLPPHARTLILDANPLKALWNHSLQPYPLLESLSLHSCHLERIGRGAFQEQGHLRSLVLGDNCLSENYKETAAALHTLPGLQTLDLSGNSLTEDMAALMLQNLSSLQSVSLARNTIMRLDDSVFEGLERLRELDLQRNYIFEIEGGAFDGLTELRHLNLAYNNLPCIVDFGLTQLRSLNVSYNVLEWFLAAGGEAAFELETLDLSHNQLLFFPLLPQYSKLHTLLLRDNNMGFYRDLYNTSSPREMVAQFLLVDGNVTNITTVNLWEEFSSSDLADLRFLDMSQNQFQYLPDGFLRKMPSLSHLNLNQNCLMTLHIREHEPPGALTELDLSHNQLSELHLTPGLASCLGSLRLFNLSSNQLLGVPPGLFANARNITTLDMSHNQISLCPLPAASDRVGPPSCVDFRNMASLRSLSLEGCGLGALPDCPFQGTSLTSLDLSSNWGVLNGSLAPLRDVAPMLQVLSLRNMGLHSNFMALDFSGFGNLRDLDLSGNCLTTFPRFGGSLALETLDLRRNSLTALPQKAVSEQLSRGLRTIYLSQNPYDCCGVDGWGALQQGQTVADWATVTCNLSSKIIRLAELPGGVPRDCKWERLDLGL

SEQ ID NO: 153 - protein, 179 aa, Homo sapiens
NECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCF

SEQ ID NO: 154 - protein, 434 aa, Homo sapiens
NECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 155 - protein, 913 aa, Homo sapiens
PSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 156 - protein, 1375 aa, Homo sapiens
NHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 157 - protein, 1260 aa, Homo sapiens
GPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 158 - protein, 645 aa, Homo sapiens
AQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNINLIIILTFILVSAILLTTLAACCCVRRQKFNQQYKA

SEQ ID NO: 159 - protein, 610 aa, Homo sapiens
AQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNIN

SEQ ID NO: 160 - protein, 674 aa, Homo sapiens
WRNRSGTATAASQGVCKLVGGAADCRGQSLASVPSSLPPHARMLTLDANPLKTLWNHSLQPYPLLESLSLHSCHLERISRGAFQEQGHLRSLVLGDNCLSENYEETAAALHALPGLRRLDLSGNALTEDMAALMLQNLSSLRSVSLAGNTIMRLDDSVFEGLERLRELDLQRNYIFEIEGGAFDGLAELRHLNLAFNNLPCIVDFGLTRLRVLNVSYNVLEWFLATGGEAAFELETLDLSHNQLLFFPLLPQYSKLRTLLLRDNNMGFYRDLYNTSSPREMVAQFLLVDGNVTNITTVSLWEEFSSSDLADLRFLDMSQNQFQYLPDGFLRKMPSLSHLNLHQNCLMTLHIREHEPPGALTELDLSHNQLSELHLAPGLASCLGSLRLFNLSSNQLLGVPPGLFANARNITTLDMSHNQISLCPLPAASDRVGPPSCVDFRNMASLRSLSLEGCGLGALPDCPFQGTSLTYLDLSSNWGVLNGSLAPLQDVAPMLQVLSLRNMGLHSSFMALDFSGFGNLRDLDLSGNCLTTFPRFGGSLALETLDLRRNSLTALPQKAVSEQLSRGLRTIYLSQNPYDCCGVDGWGALQHGQTVADWAMVTCNLSSKIIRVTELPGGVPRDCKWERLDLGLLYLVLILPSCLTLLVACTVIVLTFKKPLLQVIKSRCHWSSVY

SEQ ID NO: 161 - protein, 632 aa, Homo sapiens
WRNRSGTATAASQGVCKLVGGAADCRGQSLASVPSSLPPHARMLTLDANPLKTLWNHSLQPYPLLESLSLHSCHLERISRGAFQEQGHLRSLVLGDNCLSENYEETAAALHALPGLRRLDLSGNALTEDMAALMLQNLSSLRSVSLAGNTIMRLDDSVFEGLERLRELDLQRNYIFEIEGGAFDGLAELRHLNLAFNNLPCIVDFGLTRLRVLNVSYNVLEWFLATGGEAAFELETLDLSHNQLLFFPLLPQYSKLRTLLLRDNNMGFYRDLYNTSSPREMVAQFLLVDGNVTNITTVSLWEEFSSSDLADLRFLDMSQNQFQYLPDGFLRKMPSLSHLNLHQNCLMTLHIREHEPPGALTELDLSHNQLSELHLAPGLASCLGSLRLFNLSSNQLLGVPPGLFANARNITTLDMSHNQISLCPLPAASDRVGPPSCVDFRNMASLRSLSLEGCGLGALPDCPFQGTSLTYLDLSSNWGVLNGSLAPLQDVAPMLQVLSLRNMGLHSSFMALDFSGFGNLRDLDLSGNCLTTFPRFGGSLALETLDLRRNSLTALPQKAVSEQLSRGLRTIYLSQNPYDCCGVDGWGALQHGQTVADWAMVTCNLSSKIIRVTELPGGVPRDCKWERLDLGL

SEQ ID NO: 162 - protein, 243 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLRELIDQYDVQRADSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 163 - protein, 352 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKASRADFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 164 - protein, 352 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLRELIDQYDVQRADSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 165 - protein, 352 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLRELIDQYDVQRADSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKASRADFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 166 - protein, 383 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQGAALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 167 - protein, 382 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSGNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 168 - protein, 383 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKASRANLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 169 - protein, 383 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQGAALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKASRANLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 170 - protein, 274 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQGAALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 171 - protein, 74 aa, Homo sapiens
LSTCKTIDMELVKRKRIEAIRGQILSKLRLASPPSQGEVPPGPLPEAVLALYNSTRDRVAGESAEPEPEPEADY

SEQ ID NO: 172 - protein, 207 aa, Homo sapiens
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDI

SEQ ID NO: 173 - protein, 316 aa, Homo sapiens
EAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 174 - protein, 315 aa, Homo sapiens
AVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 175 - protein, 176 aa, Homo sapiens
YYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRR

SEQ ID NO: 176 - protein, 288 aa, Homo sapiens
YYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 177 - protein, 175 aa, Homo sapiens
YAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRR

SEQ ID NO: 178 - protein, 287 aa, Homo sapiens
YAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 179 - protein, 134 aa, Homo sapiens
FLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 180 - protein, 19 aa, Homo sapiens
GTSTYTSGDQKTIKSTRKK

SEQ ID NO: 181 - protein, 79 aa, Homo sapiens
SLSLSTCTTLDFGHIKKKRVEAIRGQILSKLRLTSPPEPTVMTHVPYQVLALYNSTRELLEEMHGEREEGCTQENTESE

SEQ ID NO: 182 - protein, 201 aa, Homo sapiens
YYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKR

SEQ ID NO: 183 - protein, 75 aa, Homo sapiens
NENSEQKENVEKEGLCNACTWRQNTKSSRIEAIKIQILSKLRLETAPNISKDVIRQLLPKAPPLRELIDQYDVQR

SEQ ID NO: 184 - protein, 278 aa, Homo sapiens
RDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 185 - protein, 288 aa, Homo sapiens
RELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 186 - protein, 168 aa, Homo sapiens
DDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 187 - protein, 96 aa, Homo sapiens
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQ

SEQ ID NO: 188 - protein, 108 aa, Homo sapiens
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEE

SEQ ID NO: 189 - protein, 178 aa, Homo sapiens
GDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 190 - protein, 64 aa, Homo sapiens
SPTPGSEGHSAAPDCPSCALAALPKDVPNSQPEMVEAVKKHILNMLHLKKRPDVTQPVPKAALL

SEQ ID NO: 191 - protein, 76 aa, Homo sapiens
SPTPGSEGHSAAPDCPSCALAALPKDVPNSQPEMVEAVKKHILNMLHLKKRPDVTQPVPKAALLNAIRKLHVGKVG

SEQ ID NO: 192 - protein, 224 aa, Homo sapiens
NAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRR

SEQ ID NO: 193 - protein, 225 aa, Homo sapiens
NAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRR

SEQ ID NO: 194 - protein, 226 aa, Homo sapiens
NAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRR

SEQ ID NO: 195 - protein, 213 aa, Homo sapiens
ENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRR

SEQ ID NO: 196 - protein, 214 aa, Homo sapiens
ENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRR

SEQ ID NO: 197 - protein, 330 aa, Homo sapiens
ENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 198 - protein, 116 aa, Homo sapiens [sequence omitted]

SEQ ID NO: 199 - protein, 395 aa, Artificial Sequence
  Description of Artificial Sequence: Synthetic polypeptide
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 200 - protein, 392 aa, Artificial Sequence
  Description of Artificial Sequence: Synthetic polypeptide
SLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 201 - protein, 361 aa, Artificial Sequence
  Description of Artificial Sequence: Synthetic polypeptide
SLSLSTCTTLDFGHIKKKRVEAIRGQILSKLRLTSPPEPTVMTHVPAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 202 - protein, 366 aa, Artificial Sequence
  Description of Artificial Sequence: Synthetic polypeptide
SLSLSTCTTLDFGHIKKKRVEAIRGQILSKLRLTSPPEPTVMTHVPYQVLALYNSTRELLEEMHGEREEGCTQENTESEYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 203 - protein, 387 aa, Artificial Sequence
  Description of Artificial Sequence: Synthetic polypeptide
LSTCKTIDMELVKRKRIEAIRGQILSKLRLASPPSQGEVPPGPLPEAVLALYNSTRDRVAGESAEPEPEPEADYYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 204 - protein, 366 aa, Artificial Sequence
  Description of Artificial Sequence: Synthetic polypeptide
SLSLSTCTTLDFGHIKKKRVEAIRGQILSKLRLTSPPEPTVMTHVPYQVLALYNSTRELLEEMHGEREEGCTQENTESEYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 205 - protein, 360 aa, Artificial Sequence
  Description of Artificial Sequence: Synthetic polypeptide
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDIGTSTYTSGDQKTIKSTRKKFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 206 - protein, 370 aa, Artificial Sequence
  Description of Artificial Sequence: Synthetic polypeptide
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDIAGIDGTSTYTSGDQKTIKSTRKKNSGKTPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 207 - protein, 373 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 208 - protein, 374 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 209 - protein, 264 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 210 - protein, 265 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 211 - protein, 419 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 212 - protein, 421 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 213 - protein, 310 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLQQILDLHDFQENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRR

SEQ ID NO: 214 - protein, 312 aa, Artificial Sequence
  Description of Artificial Sequence: Synthetic polypeptide
AEGPAAAAAAAAAAAAAGVGGERSSRPAPSVAPEPDGCPVCVWRQHSRELRLESIKSQILSKLRLKEAPNISREVVKQLLPKAPPLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRR

SEQ ID NO: 215 - protein, 362 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLRELIDQYDVQRGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 216 - protein, 361 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 217 - protein, 253 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLRELIDQYDVQRGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 218 - protein, 361 aa, Artificial Sequence; identical to SEQ ID NO: 216
  Description of Artificial Sequence: Synthetic polypeptide

SEQ ID NO: 219 - protein, 397 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLRELIDQYDVQRENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 220 - protein, 399 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 221 - protein, 289 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLRELIDQYDVQRENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRR

SEQ ID NO: 222 - protein, 290 aa, Artificial Sequence
  Description of Artificial Sequence: Synthetic polypeptide
NENSEQKENVEKEGLCNACTWRQNTKSSRIEAIKIQILSKLRLETAPNISKDVIRQLLPKAPPLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRR

SEQ ID NO: 223 - protein, 360 aa, Artificial Sequence
  Description of Artificial Sequence: Synthetic polypeptide
SPTPGSEGHSAAPDCPSCALAALPKDVPNSQPEMVEAVKKHILNMLHLKKRPDVTQPVPKAALLNAIRKLHVGKVGDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 224 - protein, 359 aa, Artificial Sequence
  Description of Artificial Sequence: Synthetic polypeptide
SPTPGSEGHSAAPDCPSCALAALPKDVPNSQPEMVEAVKKHILNMLHLKKRPDVTQPVPKAALLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 225 - protein, 244 aa, Artificial Sequence
  Description of Artificial Sequence: Synthetic polypeptide
SPTPGSEGHSAAPDCPSCALAALPKDVPNSQPEMVEAVKKHILNMLHLKKRPDVTQPVPKAALLNAIRKLHVGKVGDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 226 - protein, 243 aa, Artificial Sequence
  Description of Artificial Sequence: Synthetic polypeptide
SPTPGSEGHSAAPDCPSCALAALPKDVPNSQPEMVEAVKKHILNMLHLKKRPDVTQPVPKAALLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRR

SEQ ID NO: 227 - protein, 370 aa, Artificial Sequence
  Description of Artificial Sequence: Synthetic polypeptide
SPTPGSEGHSAAPDCPSCALAALPKDVPNSQPEMVEAVKKHILNMLHLKKRPDVTQPVPKAALLNAIRKLHVGKVGGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 228 - protein, 368 aa, Artificial Sequence
  Description of Artificial Sequence: Synthetic polypeptide
SPTPGSEGHSAAPDCPSCALAALPKDVPNSQPEMVEAVKKHILNMLHLKKRPDVTQPVPKAALLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 229 - protein, 254 aa, Artificial Sequence
  Description of Artificial Sequence: Synthetic polypeptide
SPTPGSEGHSAAPDCPSCALAALPKDVPNSQPEMVEAVKKHILNMLHLKKRPDVTQPVPKAALLNAIRKLHVGKVGGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 230 - protein, 252 aa, Artificial Sequence
  Description of Artificial Sequence: Synthetic polypeptide
SPTPGSEGHSAAPDCPSCALAALPKDVPNSQPEMVEAVKKHILNMLHLKKRPDVTQPVPKAALLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRR

SEQ ID NO: 231 - protein, 386 aa, Artificial Sequence
  Description of Artificial Sequence: Synthetic polypeptide
LSTSKTIDMELVKRKRIEAIRGQILSKLRLASPPSQGEVPPGPLPEAVLALYNSTRDRVAGESAEPEPEPEADYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 232 - protein, 370 aa, Artificial Sequence
  Description of Artificial Sequence: Synthetic polypeptide
LSTSKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTGTSTYTSGDQKTIKSTRKKHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 233 - protein, 367 aa, Artificial Sequence
  Description of Artificial Sequence: Synthetic polypeptide
SLSLSTSTTLDFGHIKKKRVEAIRGQILSKLRLTSPPEPTVMTHVPYQVLALYNSTRELLEEMHGEREEGCTQENTESEYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 234 - protein, 274 aa, Artificial Sequence
  Description of Artificial Sequence: Synthetic polypeptide
LSTSKTIDMELVKRKRIEAIRGQILSKLRLASPPSQGEVPPGPLPEAVLALYNSTRDRVAGESAEPEPEPEADYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKR

SEQ ID NO: 235 - protein, 255 aa, Artificial Sequence
  Description of Artificial Sequence: Synthetic polypeptide
SLSLSTSTTLDFGHIKKKRVEAIRGQILSKLRLTSPPEPTVMTHVPYQVLALYNSTRELLEEMHGEREEGCTQENTESEYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRR

SEQ ID NO: 236 - protein, 258 aa, Artificial Sequence
  Description of Artificial Sequence: Synthetic polypeptide
LSTSKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTGTSTYTSGDQKTIKSTRKKHGMNRPFLLLMATPLERAQHLQSSRHRR

SEQ ID NO: 237 - protein, 8 aa, Homo sapiens
AEIDGIEL

SEQ ID NO: 238 - protein, 7 aa, Homo sapiens
SVVYGLR

SEQ ID NO: 239 - protein, 9 aa, Homo sapiens
EDDMMEVPY

SEQ ID NO: 240 - protein, 8 aa, Homo sapiens
AGIDGTST

SEQ ID NO: 241 - protein, 21 aa, Homo sapiens
INGFTTGRRGDLATIHGMNRP

SEQ ID NO: 242 - protein, 10 aa, Homo sapiens
SGRRGDLATI

SEQ ID NO: 243 - protein, 10 aa, Homo sapiens
TGRRGDLATI

SEQ ID NO: 244 - protein, 27 aa, Homo sapiens
FKGVDNEDDHGRGDLGRLKKQKDHHNP

SEQ ID NO: 245 - protein, 8 aa, Homo sapiens
PGEDGLNP

SEQ ID NO: 246 - protein, 8 aa, Homo sapiens
PGAEGLHP

SEQ ID NO: 247 - protein, 6 aa, Homo sapiens
RPEATP

SEQ ID NO: 248 - protein, 21 aa, Homo sapiens
SHRKGCDTLDISVPPGSRNLP

SEQ ID NO: 249 - protein, 21 aa, Homo sapiens
RHVRISRSLHQDEHSWSQIRP

SEQ ID NO: 250 - protein, 21 aa, Homo sapiens
QHVRISRSLPQGSGNWAQLRP

SEQ ID NO: 251 - protein, 11 aa, Homo sapiens
IGRHGPQNKQP

SEQ ID NO: 252 - protein, 11 aa, Homo sapiens
VGRDGPYDKQP

SEQ ID NO: 253 - protein, 11 aa, Homo sapiens
LGQRAPRSQQP

SEQ ID NO: 254 - protein, 14 aa, Homo sapiens
RFASQGAPAGLGEP

SEQ ID NO: 255 - RNA, 80 nt, Woodchuck hepatitis virus
gccacggcggaacucaucgccgccugccuugcccgcugcuggacaggggcucggcuguugggcacugacaauuccguggu

SEQ ID NO: 256 - DNA, 592 bp, Woodchuck hepatitis virus
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctg

SEQ ID NO: 257 - protein, 22 aa, Artificial Sequence
  Description of Artificial Sequence: Synthetic peptide
MDMRVPAQLLGLLLLWFSGVLG

SEQ ID NO: 258 - DNA, 870 bp, Homo sapiens
agcttaccatggtaacccctggtcccgttcagccaccaccaccccacccagcacacctccaacctcagccagacaaggttgttgacacaagagagccctcaggggcacagagagagtctggacacgtggggagtcagccgtgtatcatcggaggcggccgggcacatggcagggatgagggaaagaccaagagtcctctgttgggcccaagtcctagacagacaaaacctagacaatcacgtggctggctgcatgcctgtggctgttgggctgggcaggaggagggaggggcgctctttcctggaggtggtccagagcaccgggtggacagccctgggggaaaacttccacgttttgatggaggttatctttgataactccacagtgacctggttcgccaaaggaaaagcaggcaacgtgagctgttttttttttctccaagctgaacactaggggtcctaggctttttgggtcacccggcatggcagacagtcaacctggcaggacatccgggagagacagacacaggcagagggcagaaaggtcaagggaggttctcaggccaaggctattggggtttgctcaattgttcctgaatgctcttacacacgtacacacacagagcagcacacacacacacacacacatgcctcagcaagtcccagagagggaggtgtcgagggggacccgctggctgttcagacggactcccagagccagtgagtgggtggggctggaacatgagttcatctatttcctgcccacatctggtataaaaggaggcagtggcccacagaggagcacagctgtgtttggctgcagggccaagagcgctgtcaagaagacccacacgcccccctccagcagctg

SEQ ID NO: 259 - DNA, 973 bp, Homo sapiens
ttggtctcctgtttccttaccaagcttttaccatggtaacccctggtcccgttcagccaccaccaccccacccagcacacctccaacctcagccagacaaggttgttgacacaagagagccctcaggggcacagagagagtctggacacgtggggagtcagccgtgtatcatcggaggcggccgggcacatggcagggatgagggaaagaccaagagtcctctgttgggcccaagtcctagacagacaaaacctagacaatcacgtggctggctgcatgccctgtggctgttgggctgggcccaggaggagggaggggcgctctttcctggaggtggtccagagcaccgggtggacagccctgggggaaaacttccacgttttgatggaggttatctttgataactccacagtgacctggttcgccaaaggaaaagcaggcaacgtgagctgttttttttttctccaagctgaacactaggggtcctaggctttttgggtcacccggcatggcagacagtcaacctggcaggacatccgggagagacagacacaggcagagggcagaaaggtcaagggaggttctcaggccaaggctattggggtttgctcaattgttcctgaatgctcttacacacgtacacacacagagcagcacacacacacacacacacatgcctcagcaagtcccagagagggaggtgtcgagggggacccgctggctgttcagacggactcccagagccagtgagtgggtggggctggaacatgagttcatctatttcctgcccacatctggtataaaaggaggcagtggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggta

SEQ ID NO: 260 - DNA, 1094 bp, Homo sapiens
ccatggcaaacaaaactcttctctaagtcaccaatgatcacaggcctcccactaaaaatacttcccaactctggggtggaagagtttgggggatgaatttttaggggattgcaagccccaatccccacctctgtgtccctagaatcccccacccctaccttggctgctccatcacccaaccaccaaagctttcttctgcagaggccacctagtcatgtttctcaccctgcacctcagcctccccactccatctctcaatcatgcctagggtttggaggaaggcatttgattctgttctggagcacagcagaagaattgacatcctcaaaattaaaactcccttgcctgcacccctccctcagatatctgattcttaatgtctagaaaggaatctgtaaattgttccccaaatattcctaagctccatcccctagccacaccagaagacacccccaaacaggcacatctttttaattcccagcttcctctgttttggagaggtcctcagcatgcctctttatgcccctcccttagctcttgccaggatatcagagggtgactggggcacagccaggaggaccccctccccaacacccccaacccttccacctttggaagtctccccacccagctccccagttccccagttccacttcttctagattggaggtcccaggaagagagcagaggggcacccctacccactggttagcccacgccattctgaggacccagctgcacccctaccacagcacctctggcccaggctgggctggggggctggggaggcagagctgcgaagaggggagatgtggggtggactcccttccctcctcctccccctctccattccaactcccaaattgggggccgggccaggcagctctgattggctggggcacgggcggccggctccccctctccgaggggcagggttcctccctgctctccatcaggacagtataaaaggggcccgggccagtcgtcggagcagacgggagtttctcctcggggtcggagcaggaggcacgcggagtgtgaggccacgcatgagcggacgctaaccccctccccagccacaaagagtctacatg

SEQ ID NO: 261 - DNA, 955 bp, Homo sapiens
tagagttcgcaaagcctatcctccctgtagccgggtgccaagcagcctcgagcctgctccccagcccacctgccaacaaaaggcgccctccgactgcaacccagccctccacagacaggacccgccctttcccgaagtcataagacaaagagagtgcatcactgctgaaacagtgggcgcacacgagccccaaagctagagaaaagctggacggggctgggggcggggtgcaggggtggaggggcggggaggcgggctccggctgcgccacgctatcgagtcttccctccctccttctctgccccctccgctcccgctggagccctccaccctacaagtggcctacagggcacaggtgaggcgggactggacagctcctgctttgatcgccggagatctgcaaattctgcccatgtcggggctgcagagcactccgacgtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaa

SEQ ID NO: 262 - DNA, 1043 bp, Homo sapiens
agtaaaagaccccaaaggctgagggcctcagaagcatcaggccatgatgttcctgaaacaagagggtcagggtcccaatgggcctctggggttcatcgtgaggatggatgcattaatattggggacctgctagggaccttcccagtgggacagtggctgggtcagggcactcaagccctaaaacgtgatgaggcgagacttttctctctttcctcattcagtaactgtcagtagattctgggagccagggattctccgactcttcaagtccatgaattttaggggatgacagtgggctctccgctttctcctccatgaagtaacttacatgcccctcaccctctgtgggaggggtgttgcagggggtgcagaactcccctcgccgggtagttcaagcaatggggaccatatcaattccatctatagggaaactgaggcctggagtagggcgaggcctctgggaacccagccctattctgtctctttccctggcatttcccatccacacatagagcttcagattctctttctttccccagagaccctcaaatatcctctcactcacagaatggtgtctctgcctgcctcgggttggccctgtgatttattttagttcttttcccttgttttttttttttcaaactctatacacttttgttttaaaaactgtggtttctcatgagccctattatctcattgatacctctcacctctgtggtgaggggaagaaatcatattttcagatgactcgtaaagggcaaagaaaaaaacccaaaatttcaaaatttccgtttaagtctcataatcaagaaaaggagaaacacagagagagagaaaaaaaaaactatgagaacccccccccaccccgtgattatcagcgcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcacca

SEQ ID NO: 263 - DNA, 108 bp, Unknown
  Description of Unknown: CAGA12 polynucleotide
agccagacaagccagacaagccagacaagccagacaagccagacaagccagacaagccagacaagccagacaagccagacaagccagacaagccagacaagccagaca

SEQ ID NO: 264 - DNA, 46 bp, Human adenovirus
gggctataaaagggggtgggggcgcgttcgtcctcactctcttccg

SEQ ID NO: 265 - protein, 8 aa, Artificial Sequence
  Description of Artificial Sequence: Synthetic peptide
DYKDDDDK

SEQ ID NO: 266 - protein, 8 aa, Unknown
  Description of Unknown: 3C protease cleavage site peptide
LEVLFQGP

SEQ ID NO: 267 - protein, 387 aa, Artificial Sequence
  Description of Artificial Sequence: Synthetic polypeptide
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 268 - protein, 387 aa, Artificial Sequence
  Description of Artificial Sequence: Synthetic polypeptide
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 269 - protein, 387 aa, Artificial Sequence
  Description of Artificial Sequence: Synthetic polypeptide
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 270 - protein, 391 aa, Artificial Sequence
  Description of Artificial Sequence: Synthetic polypeptide
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 271 - protein, 391 aa, Artificial Sequence
  Description of Artificial Sequence: Synthetic polypeptide
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 272 - protein, 395 aa, Artificial Sequence
  Description of Artificial Sequence: Synthetic polypeptide
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGFTGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 273 - protein, 386 aa, Artificial Sequence
  Description of Artificial Sequence: Synthetic polypeptide
SLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDTGRRGDLATINSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 274 - protein, 86 aa, Homo sapiens
DIDECMLFGSEICKEGKCVNTQPGYECYCKQGFYYDGNLLECVDVDECLDESNCRNGVCENTRGGYRCACTPPAEYSPAQRQCLSP

SEQ ID NO: 275 - protein, 43 aa, Homo sapiens
DVDECQDPAACRPGRCVNLPGSYRCECRPPWVPGPSGRDCQLP

SEQ ID NO: 276 - protein, 43 aa, Homo sapiens
DIDECSQDPSLCLPHGACKNLQGSYVCVCDEGFTPTQDQHGCE

SEQ ID NO: 277 - protein, 43 aa, Homo sapiens
DIDECMLFGSEICKEGKCVNTQPGYECYCKQGFYYDGNLLECV

SEQ ID NO: 278 - protein, 57 aa, Homo sapiens
KKECYLNFDDTVFCDSVLATNVTQQECCCSLGAGWGDHCEIYPCPVYSSAEFHSLCP

SEQ ID NO: 279 - protein, 52 aa, Homo sapiens
DVCWSQRGEDGMCAGPLAGPALTFDDCCCRQGRGWGAQCRPCPPRGAGSHCP

SEQ ID NO: 280 - protein, 277 aa, Homo sapiens
KKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSE

SEQ ID NO: 281 - protein, 230 aa, Homo sapiens
KKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSE

SEQ ID NO: 282 - protein, 174 aa, Homo sapiens
DIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDE

SEQ ID NO: 283 - protein, 175 aa, Homo sapiens
QDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDE

SEQ ID NO: 284 - protein, 170 aa, Homo sapiens
DIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECV

SEQ ID NO: 285 - protein, 171 aa, Homo sapiens
QDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECV

SEQ ID NO: 286 - protein, 305 aa, Artificial Sequence
  Description of Artificial Sequence: Synthetic polypeptide
MDMRVPAQLLGLLLLWFSGVLGKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSEHHHHHH

SEQ ID NO: 287 - protein, 258 aa, Artificial Sequence
  Description of Artificial Sequence: Synthetic polypeptide
MDMRVPAQLLGLLLLWFSGVLGKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSEHHHHHH

SEQ ID NO: 288 - protein, 202 aa, Artificial Sequence
  Description of Artificial Sequence: Synthetic polypeptide
MDMRVPAQLLGLLLLWFSGVLGDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDEHHHHHH

SEQ ID NO: 289 - protein, 205 aa, Artificial Sequence
  Description of Artificial Sequence: Synthetic polypeptide
MDMRVPAQLLGLLLLWFSGVLGHHHHHHSSGDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDE

SEQ ID NO: 290 - protein, 206 aa, Artificial Sequence
  Description of Artificial Sequence: Synthetic polypeptide
MDMRVPAQLLGLLLLWFSGVLGHHHHHHSSGQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDE

SEQ ID NO: 291 - protein, 201 aa, Artificial Sequence
  Description of Artificial Sequence: Synthetic polypeptide
MDMRVPAQLLGLLLLWFSGVLGHHHHHHSSGDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECV

SEQ ID NO: 292 - protein, 202 aa, Artificial Sequence
  Description of Artificial Sequence: Synthetic polypeptide
MDMRVPAQLLGLLLLWFSGVLGHHHHHHSSGQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECV

SEQ ID NO: 293 - protein, 249 aa, Artificial Sequence
  Description of Artificial Sequence: Synthetic polypeptide
SLSTSSTLDMDQFMRKRIEAIRGQILSKLKLTSPPEDYPEPEEVPPEVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRR

SEQ ID NO: 294 - protein, 279 aa, Artificial Sequence
  Description of Artificial Sequence: Synthetic polypeptide
SLSTSSTLDMDQFMRKRIEAIRGQILSKLKLTSPPEDYPEPEEVPPEVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKR

SEQ ID NO: 295 - protein, 6 aa, Artificial Sequence
  Description of Artificial Sequence: Synthetic 6xHis tag
HHHHHH

SEQ ID NO: 296 - protein, 361 aa, Sus scrofa
LSTCKTIDMELVKRKRIEAIRGQILSKLRLASPPSQGDVPPGPLPEAVLALYNSTRDRVAGESVEPEPEPEADYYAKEVTRVLMVESGNQIYDKFKGTPHSLYMLFNTSELREAVPEPVLLSRAELRLLRLKLKVEQHVELYQKYSNDSWRYLSNRLLAPSDSPEWLSFDVTGVVRQWLTRREAIEGFRLSAHCSCDSKDNTLHVEINGFNSGRRGDLATIHGMNRPFLLLMATPLERAQHLHSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 297 - protein, 375 aa, Artificial Sequence
  Description of Artificial Sequence: Synthetic polypeptide
MQKLQLCVYIYLFMLIVAGPVDLNENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

The invention claimed is:

1. A method of producing an antibody capable of binding a growth factor prodomain complex (GPC), said GPC consisting of at least one GDF-8 growth factor and at least one GDF-8 prodomain, said method comprising:
   a. expressing proGDF-8 (SEQ ID NO: 5),
   b. forming the GPC by subjecting the expressed proGDF-8 (SEQ ID NO: 5) to enzymatic cleavage with one or more of furin, bone morphogenetic protein-1 (BMP-1), mammalian tolloid protein (mTLD), mammalian tolloid-like 1 (mTLL1), and mammalian tolloid-like 2 (mTLL2),
   c. carrying out solid-phase or solution-phase enrichment with an antibody fragment phage display library, wherein the GPC formed by enzymatic cleavage is used as a target antigen;
   d. selecting phage particles bound to the GPC formed by enzymatic cleavage; and
   e. producing recombinant antibodies having complementarity determining region (CDR) amino acid sequences obtained from the antibody fragments expressed at the surface of the phage particles selected in (d).

2. The method of claim 1, further comprising
   f. conducting a negative selection binding assay of the recombinant antibodies produced in (e) to remove antibodies that bind to one or more undesired antigens.

3. The method of claim 2, wherein said one or more undesired antigens are selected from the group consisting of GDF-8 prodomain, GDF-8 growth factor, murine proGDF-8, proGDF-11, proTGF-β1 and a protein with an amino acid sequence selected from the group consisting of SEQ ID NOs: 207-230.

4. The method of claim 1, wherein phage particle binding is determined using one or more binding assays selected from the group consisting of enzyme-linked immunosorbent assays, surface plasmon resonance assays, and flow cytometry assays.

5. The method of claim 1, wherein said enzymatic cleavage comprises sequential enzymatic cleavage with at least two enzymes.

6. The method of claim 1, further comprising
   f. screening the recombinant antibodies of (e) and selecting those which reduce GDF-8 growth factor activity.

7. The method of claim 6, wherein said enzymatic cleavage comprises sequential enzymatic cleavage with at least two enzymes.

* * * * *